United States Patent 11,872,280 (RNA VACCINE AGAINST SARS-COV-2 VARIANTS) - sequence listing, part 2

SEQ ID NO: 27210 - RNA, 3816 nt, Artificial Sequence
  SARS-CoV-2/Wuhan/WIV05/2019__EPI_ISL_402128 spike protein CDS gc mod (1-1273)(K986P_V987P_T19R_F157del_R158del_L452R_T478K_D614G_P681R _D950N)
auguucguguuucuggugcugcugccccugguguccagccagugugugaaccugcgcaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27211 - RNA, 3801 nt, Artificial Sequence
  SARS-CoV-2/Wuhan/WIV05/2019__EPI_ISL_402128 spike protein CDS gc mod (1-1273)(K986P_V987P_G75V_T76I_R246del_S247del_Y248del_L249del_T2 50del_P251del_G252del_L452Q_F490S_D614G_T859N)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaaugugaucaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccaguaccggcuguuccggaaguccaaucugaagcccuucgagcgggacaucagcaccgaaaucuaucaggccggcagcaccccuugcaacggcguggaaggcuucaacugcuacagcccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugaacgugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27212 - RNA, 3816 nt, Artificial Sequence
  SARS-CoV-2/Wuhan/WIV05/2019__EPI_ISL_402128 spike protein CDS gc mod (1-1273)(K986P_V987P_H69del_V70del_N439K_D614G)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27213 - RNA, 3822 nt, Artificial Sequence
  SARS-CoV-2/Wuhan/WIV05/2019__EPI_ISL_402128 spike protein CDS gc mod (1-1273)(K986P_V987P_L5F_T95I_D253G_E484K_D614G_A701V)
auguucguguuuuucgugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27214 - RNA, 3822 nt, Artificial Sequence
  SARS-CoV-2/Wuhan/WIV05/2019__EPI_ISL_402128 spike protein CDS gc mod (1-1273)(K986P_V987P_L5F_T95I_D253G_S477N_D614G_Q957R)
auguucguguuuuucgugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccgcgcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27215 - RNA, 3822 nt, Artificial Sequence
  SARS-CoV-2/Wuhan/WIV05/2019__EPI_ISL_402128 spike protein CDS gc mod (1-1273)(K986P_V987P_F157L_V367F_Q613H_P681R)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagcugcggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccuuccuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccacgacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27216 - RNA, 3822 nt, Artificial Sequence
  SARS-CoV-2/Wuhan/WIV05/2019__EPI_ISL_402128 spike protein CDS gc mod (1-1273)(K986P_V987P_S254F_D614G_P681R_G769V)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauuucagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagugaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27217 - RNA, 3804 nt, Artificial Sequence
  SARS-CoV-2/Wuhan/WIV05/2019__EPI_ISL_402128 spike protein CDS gc mod (1-1273)(K986P_V987P_P26S_H69del_V70del_V126A_Y144del_L242del_A24 3del_L244del_H245Y_S477N_E484K_D614G_P681H_T1027I_D1118H)
auguucguguuucuggugcugcugccccugguguccagccagugugugaaccugaccaccagaacacagcugccuagcgccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacgccgucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacuguacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27218 - RNA, 3825 nt, Artificial Sequence
  SARS-CoV-2/Wuhan/WIV05/2019__EPI_ISL_402128 spike protein CDS gc mod (1-1273)(K986P_V987P_T95I_Y144T_Y145S_ins145N_R346K_E484K_N501Y_D 614G_P681H_D950N)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucaccagcaaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccaaguucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27219 - RNA, 3831 nt, Artificial Sequence
  SARS-CoV-2/Wuhan/WIV05/2019__EPI_ISL_402128 spike protein CDS gc mod (1-1273)(K986P_V987P_ins214TDR_Q414K_N450K_D614G_T716I)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggaccgaccgcgaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggaaagacaggcaagaucgccgacuacaacuacaagcugcccgacgacuucaccggcugugugauugccuggaacagcaacaaccuggacuccaaagucggcggcaacuacaaguaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27220 - RNA, 3822 nt, Artificial Sequence
  SARS-CoV-2/Wuhan/WIV05/2019__EPI_ISL_402128 spike protein CDS gc mod (1-1273)(K986P_V987P_T478K_D614G_P681H_T732A)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccauggccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27221 - RNA, 3822 nt, Artificial Sequence
  SARS-CoV-2/Wuhan/WIV05/2019__EPI_ISL_402128 spike protein CDS gc mod (1-1273)(K986P_V987P_E484K_N501Y_D614G_P681H_E1092K_H1101Y_V1176F )
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagaaagggcguguucguguccaacggcaccuacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27222 - RNA, 3816 nt, Artificial Sequence
  SARS-CoV-2/Wuhan/WIV05/2019__EPI_ISL_402128 spike protein CDS gc mod (1-1273)(K986P_V987P_H66D_G142V_Y144del_Y145del_D215G_V483A_D614G _H655Y_G669S_Q949R_N1187D)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguucgacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccuggugguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgccgaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuagcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcgcgacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcuggacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27223 - RNA, 3819 nt, Artificial Sequence
  SARS-CoV-2/Wuhan/WIV05/2019__EPI_ISL_402128 spike protein CDS gc mod (1-1273)(K986P_V987P_Y144del_L452R_T478K_P681R)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27224 - RNA, 3816 nt, Artificial Sequence
  SARS-CoV-2/Wuhan/WIV05/2019__EPI_ISL_402128 spike protein CDS gc mod (1-1273)(K986P_V987P_T19R_Y144del_Y145del_L452R_T478K_D614G_P681R )
auguucguguuucuggugcugcugccccugguguccagccagugugugaaccugcgcaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27225 - RNA, 3813 nt, Artificial Sequence
  SARS-CoV-2/Wuhan/WIV05/2019__EPI_ISL_402128 spike protein CDS gc mod (1-1273)(K986P_V987P_H69del_V70del_Y144del_E484K_N501Y_A570D_D614 G_P681H_T716I_S982A_D1118H)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27226 - RNA, 3813 nt, Artificial Sequence
  SARS-CoV-2/Wuhan/WIV05/2019__EPI_ISL_402128 spike protein CDS gc mod (1-1273)(K986P_V987P_L18F_D80A_D215G_L242del_A243del_L244del_K417 N_E484K_N501Y_D614G_A701V)
auguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27227 - RNA, 3813 nt, Artificial Sequence
  SARS-CoV-2/Wuhan/WIV05/2019__EPI_ISL_402128 spike protein CDS gc mod (1-1273)(K986P_V987P_Q52R_A67V_H69del_V70del_Y144del_E484K_D614G_ Q677H_F888L)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccgcgaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacacacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27228 - RNA, 3813 nt, Artificial Sequence
  SARS-CoV-2/Wuhan/WIV05/2019__EPI_ISL_402128 spike protein CDS gc mod (1-1273)(K986P_V987P_A67V_H69del_V70del_Y144del_E484K_D614G_Q677H _F888L)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacacacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27229 - RNA, 3822 nt, Artificial Sequence
  SARS-CoV-2/Wuhan/WIV05/2019__EPI_ISL_402128 spike protein CDS gc mod (1-1273)(K986P_V987P_L18F_T20N_P26S_D138Y_R190S_K417T_E484K_N501Y _D614G_H655Y_T1027I_V1176F)
auguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27230 - RNA, 3822 nt, Artificial Sequence
  SARS-CoV-2/Wuhan/WIV05/2019__EPI_ISL_402128 spike protein CDS gc mod (1-1273)(K986P_V987P_E484K_D614G_V1176F)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27231 - RNA, 3822 nt, Artificial Sequence
  SARS-CoV-2/Wuhan/WIV05/2019__EPI_ISL_402128 spike protein CDS gc mod (1-1273)(K986P_V987P_L452R_D614G_P681R)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27232 - RNA, 3822 nt, Artificial Sequence
  SARS-CoV-2/Wuhan/WIV05/2019__EPI_ISL_402128 spike protein CDS gc mod (1-1273)(K986P_V987P_E154K_L452R_E484Q_D614G_P681R_Q1071H)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggaugaagagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcgugcagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucacgagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27233 - RNA, 3816 nt, Artificial Sequence
  SARS-CoV-2/Wuhan/WIV05/2019__EPI_ISL_402128 spike protein CDS gc mod (1-1273)(K986P_V987P_T19R_F157del_R158del_L452R_T478K_D614G_P681R _D950N)
auguucguguuccuggugcugcugccucugguguccagccagugugugaaccugcgcaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27234 - RNA, 3801 nt, Artificial Sequence
  SARS-CoV-2/Wuhan/WIV05/2019__EPI_ISL_402128 spike protein CDS gc mod (1-1273)(K986P_V987P_G75V_T76I_R246del_S247del_Y248del_L249del_T2 50del_P251del_G252del_L452Q_F490S_D614G_T859N)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaaugugaucaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccaguaccggcuguuccggaaguccaaucugaagcccuucgagcgggacaucuccaccgagaucuaucaggccggcagcaccccuuguaacggcguggaaggcuucaacugcuacagcccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugaacgugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27235 - RNA, 3816 nt, Artificial Sequence
  SARS-CoV-2/Wuhan/WIV05/2019__EPI_ISL_402128 spike protein CDS gc mod (1-1273)(K986P_V987P_H69del_V70del_N439K_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27236 - RNA, 3822 nt, Artificial Sequence
  SARS-CoV-2/Wuhan/WIV05/2019__EPI_ISL_402128 spike protein CDS gc mod (1-1273)(K986P_V987P_L5F_T95I_D253G_E484K_D614G_A701V)
auguucguguucuucgugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27237 - RNA, 3822 nt, Artificial Sequence
  SARS-CoV-2/Wuhan/WIV05/2019__EPI_ISL_402128 spike protein CDS gc mod (1-1273)(K986P_V987P_L5F_T95I_D253G_S477N_D614G_Q957R)
auguucguguucuucgugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccgcgcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27238 - RNA, 3822 nt, Artificial Sequence
  SARS-CoV-2/Wuhan/WIV05/2019__EPI_ISL_402128 spike protein CDS gc mod (1-1273)(K986P_V987P_F157L_V367F_Q613H_P681R)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagcugcggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccuuccuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccacgacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27239 - RNA, 3822 nt, Artificial Sequence
  SARS-CoV-2/Wuhan/WIV05/2019__EPI_ISL_402128 spike protein CDS gc mod (1-1273)(K986P_V987P_S254F_D614G_P681R_G769V)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauuucagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagugaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27240 - RNA, 3804 nt, Artificial Sequence
  SARS-CoV-2/Wuhan/WIV05/2019__EPI_ISL_402128 spike protein CDS gc mod (1-1273)(K986P_V987P_P26S_H69del_V70del_V126A_Y144del_L242del_A24 3del_L244del_H245Y_S477N_E484K_D614G_P681H_T1027I_D1118H)
auguucguguuccuggugcugcugccucugguguccagccagugugugaaccugaccaccagaacacagcugccuagcgccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacgccgucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacuguacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27241 - RNA, 3825 nt, Artificial Sequence
  SARS-CoV-2/Wuhan/WIV05/2019__EPI_ISL_402128 spike protein CDS gc mod (1-1273)(K986P_V987P_T95I_Y144T_Y145S_ins145N_R346K_E484K_N501Y_D 614G_P681H_D950N)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucaccagcaaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccaaguucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27242 - RNA, 3831 nt, Artificial Sequence
  SARS-CoV-2/Wuhan/WIV05/2019__EPI_ISL_402128 spike protein CDS gc mod (1-1273)(K986P_V987P_ins214TDR_Q414K_N450K_D614G_T716I)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggaccgaccgcgaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggaaagacaggcaagaucgccgacuacaacuacaagcugcccgacgacuucaccggcugugugauugccuggaacagcaacaaccuggacuccaaagucggcggcaacuacaaguaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27243 - RNA, 3822 nt, Artificial Sequence
  SARS-CoV-2/Wuhan/WIV05/2019__EPI_ISL_402128 spike protein CDS gc mod (1-1273)(K986P_V987P_T478K_D614G_P681H_T732A)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccauggccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27244 - RNA, 3822 nt, Artificial Sequence
  SARS-CoV-2/Wuhan/WIV05/2019__EPI_ISL_402128 spike protein CDS gc mod (1-1273)(K986P_V987P_E484K_N501Y_D614G_P681H_E1092K_H1101Y_V1176F )
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagaaagggcguguucguguccaacggcaccuacugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27245 - RNA, 3816 nt, Artificial Sequence
  SARS-CoV-2/Wuhan/WIV05/2019__EPI_ISL_402128 spike protein CDS gc mod (1-1273)(K986P_V987P_H66D_G142V_Y144del_Y145del_D215G_V483A_D614G _H655Y_G669S_Q949R_N1187D)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguucgacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccuggugguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgccgaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuagcaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcgcgacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcuggacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27246 - RNA, 3819 nt, Artificial Sequence
  SARS-CoV-2/Wuhan/WIV05/2019__EPI_ISL_402128 spike protein CDS gc mod (1-1273)(K986P_V987P_Y144del_L452R_T478K_P681R)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27247 - RNA, 3816 nt, Artificial Sequence
  SARS-CoV-2/Wuhan/WIV05/2019__EPI_ISL_402128 spike protein CDS gc mod (1-1273)(K986P_V987P_T19R_Y144del_Y145del_L452R_T478K_D614G_P681R )
auguucguguuccuggugcugcugccucugguguccagccagugugugaaccugcgcaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 27248 - RNA, 4030 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H) R10409
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27249 - RNA, 4030 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V) R10509
aggagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacagguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27250 - RNA, 4030 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L) R10519
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccgcgaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27251 - RNA, 4030 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L) R10576
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27252 - RNA, 4039 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F) P5322
aggagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27253 - RNA, 4039 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27254 - RNA, 4039 nt, Artificial Sequence
  SARS-CoV-2/Wuhan/WIV05/2019__EPI_ISL_402128 spike protein mRNA gc (1-1273)(K986P_V987P_L452R_D614G_P681R) R10597
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27255 - RNA, 4039 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27256 - RNA, 4033 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagaaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27257 - RNA, 4018 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcacgacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccaguaccgccuguuccgcaagagcaaccucaagcccuucgagcgggacaucuccaccgagaucuaccaggccggcagcacccccugcaacgggguggagggcuucaacugcuacagcccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27258 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_N439K_D614G) R10574
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27259 - RNA, 4039 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V) R10578
aggagaaagcuuaccauguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27260 - RNA, 4039 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R) R10580
aggagaaagcuuaccauguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccgcgcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27261 - RNA, 4039 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R) R10591
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccacgacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27262 - RNA, 4039 nt, Artificial Sequence
  SARS-CoV-2/Wuhan/WIV05/2019__EPI_ISL_402128 spike protein mRNA gc (1-1273)(K986P_V987P_S254F_D614G_P681R_G769V) P5307
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacuucagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggugaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27263 - RNA, 4021 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H) P5417
aggagaaagcuuaccauguucguguuccugguccuccugccccuggugagcucccagugcgugaaccucaccacccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacgccgucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccucuaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27264 - RNA, 4042 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N) R10678
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugaccagcaaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccaaguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27265 - RNA, 4048 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I) P5419
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggaccgaccgcgaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggcaagaccgggaagaucgccgacuacaacuacaagcugccggacgacuucacgggcugcgugaucgcguggaacagcaacaaccucgacuccaaggucgggggcaacuacaaguaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27266 - RNA, 4039 nt, Artificial Sequence
  SARS-CoV-2/Wuhan/WIV05/2019__EPI_ISL_402128 spike protein mRNA gc (1-1273)(K986P_V987P_T478K_D614G_P681H_T732A) P5415
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcauggccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27267 - RNA, 4039 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcaagggcguguucguguccaacgggaccuacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27268 - RNA, 4033 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguucgacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucguggugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccagcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcgcgacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccuggacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27269 - RNA, 4036 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27270 - RNA, 4033 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagaaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27271 - RNA, 4030 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27272 - RNA, 4030 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcaccgguccuaccucacgccgggcgacagcagcuccggcuggaccgcgggggccgccgccuacuacgugggcuaccugcagccccgcaccuuccugcucaaguacaacgagaacgggaccaucacggacgcggucgacugcgcccuggacccccugagcgagaccaagugcacccucaaguccuucaccguggagaagggcaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggggucagccccaccaagcucaacgaccugugcuucaccaacguguacgccgacuccuucgugauccgcggcgacgagguccggcagaucgcccccgggcagaccggcaacaucgccgacuacaacuacaagcugccggacgacuucacggggugcgugaucgcguggaacagcaacaaccucgacuccaaggugggcggcaacuacaacuaccuguaccgccuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccggguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgcgacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggcgccgggaucugcgccagcuaccagacgcagaccaacuccccgcggcgcgcccggagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgcgcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgguccuucaucgaggaccuccuguucaacaaggugacccuggccgacgccggguucaucaagcaguacggcgacugccucggggacaucgccgcgcgcgaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgguucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccuggggcagagcaagcggguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgcgagggcguguucguguccaacggcacccacugguucgucacgcagcggaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27273 - RNA, 4030 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccgggaccucuuccugcccuucuucagcaacgucacgugguuccacgugaucuccgggaccaacggcaccaagcgcuucgacaacccggugcugcccuucaacgacggggucuacuucgccagcaccgagaaguccaacaucauccggggcuggaucuucgggacgacccucgacagcaagacccagucccugcugaucgugaacaacgcgaccaacguggucaucaaggugugcgaguuccaguucugcaacgaccccuuccucggcguguaccacaagaacaacaagagcuggauggaguccgaguuccgcgucuacagcuccgccaacaacugcacguucgaguacgugagccagcccuuccugauggaccuggagggcaagcaggggaacuucaagaaccuccgggaguucguguucaagaacaucgacggcuacuucaagaucuacuccaagcacaccccgaucaaccugguccgcgaccugccccagggguucagcgcccucgagccccugguggaccugcccaucggcaucaacaucacccgguuccagacccuccuggcccugcaccgcuccuaccucacgccgggggacagcagcuccggcuggaccgccggcgcggccgccuacuacgugggguaccugcagccccggaccuuccugcucaaguacaacgagaacggcaccaucacggacgccgucgacugcgcgcuggacccccugagcgagaccaagugcacccucaaguccuucaccguggagaaggggaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccggcuguuccgcaagagcaaccucaagcccuucgagcgggacaucuccaccgagaucuaccaggcgggcagcacccccugcaacggggugaagggcuucaacugcuacuucccccugcaguccuacggguuccagccgaccaacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgggacccccagacccuggagauccucgacaucacccccugcagcuucggcgggguguccgugaucacgccgggcaccaacaccagcaaccaggucgcggugcuguaccagggcgugaacugcaccgagguccccguggccauccacgccgaccagcugacgcccaccuggcgcguguacuccaccgggagcaacgucuuccagacccgggccggcugccucaucggggccgagcacgugaacaacuccuacgagugcgacauccccaucggcgcgggcaucugcgccagcuaccagacgcacaccaacuccccgcgccgggcccgcagcguggccucccagagcaucaucgcguacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcccugacgggcaucgcgguggagcaggacaagaacacccaggagguguucgcccaggucaagcagaucuacaagacgcccccgaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccucggcgacaucgccgcgcgggaccugaucugcgcccagaaguucaacgggcugaccgugcucccgccccugcugaccgacgagaugaucgcccaguacaccagcgcccuccuggccggcaccaucacguccggguggacccugggcgcgggcgccgcccuccagauccccuucgccaugcagauggcguaccgcuucaacgggaucggcgucacccagaacgugcuguacgagaaccagaagcugaucgccaaccaguucaacagcgccaucgggaagauccaggacucccucagcuccaccgccagcgcccugggcaagcugcaggacguggucaaccagaacgcgcaggcccucaacacgcuggugaagcagcuguccagcaacuucggggccaucuccagcgugcucaacgacauccugucccggcuggacccgcccgaggccgagguccagaucgaccgccucaucaccggccggcugcagagccugcagaccuacgugacccagcagcucauccgcgccgcggagauccgggccagcgccaaccuggccgccaccaagauguccgagugcgugcugggccagagcaagcgcgucgacuucugcgggaagggcuaccaccucauguccuucccccagagcgcgccccacggggugguguuccugcacgucacguacgugcccgcccaggagaagaacuucaccaccgccccggccaucugccacgacggcaaggcgcacuucccccgggagggggucuucguguccaacggcacccacugguucgugacgcagcgcaacuucuacgagccccagaucaucaccaccgacaacaccuucgucagcggcaacugcgacguggugaucgggaucgucaacaacacgguguacgacccccugcagccggagcucgacuccuucaaggaggagcuggacaaguacuucaagaaccacaccagccccgacguggaccugggcgacaucuccgggaucaacgccagcgucgugaacauccagaaggagaucgaccggcucaacgagguggccaagaaccugaacgagucccugaucgaccuccaggagcugggcaaguacgagcaguacaucaaguggcccugguacaucuggcugggcuucaucgccgggcucaucgccaucgucauggugaccaucaugcugugcugcaugaccagcugcugcuccugccugaagggcugcugcagcugcggguccugcugcaaguucgacgaggacgacagcgagccggugcucaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27274 - RNA, 4030 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgccagcaccgagaaguccaacaucauccgcggcuggaucuucgggacgacccucgacagcaagacccagucccugcugaucgugaacaacgcgaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcgggguguccgugaucacgccgggcaccaacaccagcaaccaggucgcggugcuguaccagggcgugaacugcaccgagguccccguggccauccacgccgaccagcugacgcccaccuggcggguguacuccaccgggagcaacgucuuccagacccgcgccggcugccucaucggggccgagcacgugaacaacuccuacgagugcgacauccccaucggcgcgggcaucugcgccagcuaccagacgcacaccaacuccccgcggcgcgcccggagcguggccucccagagcaucaucgcguacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcccugacgggcaucgcgguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccgugcucccgccccugcugaccgacgagaugaucgcccaguacaccagcgcccuccuggccggcaccaucacguccggguggacccugggcgcgggcgccgcccuccagauccccuucgccaugcagauggcguaccgguucaacgggaucggcgucacccagaacgugcuguacgagaaccagaagcugaucgccaaccaguucaacagcgccaucgggaagauccaggacucccucagcuccaccgccagcgcccugggcaagcugcaggacguggucaaccagaacgcgcaggcccucaacacgcuggugaagcagcuguccagcaacuucggggccaucuccagcgugcucaacgacauccugucccgccuggacccgcccgaggccgagguccagaucgaccggcucaucaccggccgccugcagagccugcagaccuacgugacccagcagcucauccgggccgcggagauccgcgccagcgccaaccuggccgccaccaagauguccgagugcgugcugggccagagcaagcgggucgacuucugcgggaagggcuaccaccucauguccuucccccagagcgcgccccacggggugguguuccugcacgucacguacgugcccgcccaggagaagaacuucaccaccgccccggccaucugccacgacggcaaggcgcacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcucgacuccuucaaggaggagcuggacaaguacuucaagaaccacaccagccccgacguggaccugggcgacaucuccgggaucaacgccagcgucgugaacauccagaaggagaucgaccgccucaacgagguggccaagaaccugaacgagucccugaucgaccuccaggagcugggcaaguacgagcaguacaucaaguggcccugguacaucuggcugggcuucaucgccgggcucaucgccaucgucauggugaccaucaugcugugcugcaugaccagcugcugcuccugccugaagggcugcugcagcugcggguccugcugcaaguucgacgaggacgacagcgagccggugcucaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27275 - RNA, 4039 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcuucgucaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgugauggucaccaucaugcugugcugcaugaccagcugcugcuccugccucaagggcugcugcagcugcggguccugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27276 - RNA, 4039 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcuucgucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27277 - RNA, 4039 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcacccccugcaacgggguggagggcuucaacugcuacuucccccuccaguccuacggguuccagccgaccaacggcgugggguaccagcccuaccgcguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcgcguguacuccaccgggagcaacgucuuccagacccgggccggcugccugaucggggcggagcacgugaacaacuccuacgagugcgacauccccaucggcgccggcaucugcgccagcuaccagacgcagaccaacucccgccggcgcgcccggagcguggcgucccagagcaucaucgccuacaccaugucccucggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacccgcccgaggccgagguccagaucgaccggcugaucaccggccgccugcagagccuccagaccuacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucacguacgugcccgcccaggagaagaacuucaccaccgcccccgccaucugccacgacggcaaggcccacuucccgcgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27278 - RNA, 4039 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcacccccugcaacggggugcagggcuucaacugcuacuucccccuccaguccuacggguuccagccgaccaacggcgugggguaccagcccuaccgcguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcgcguguacuccaccgggagcaacgucuuccagacccgggccggcugccugaucggggcggagcacgugaacaacuccuacgagugcgacauccccaucggcgccggcaucugcgccagcuaccagacgcagaccaacucccgccggcgcgcccggagcguggcgucccagagcaucaucgccuacaccaugucccucggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacccgcccgaggccgagguccagaucgaccggcugaucaccggccgccugcagagccuccagaccuacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucacguacgugcccgcccacgagaagaacuucaccaccgcccccgccaucugccacgacggcaaggcccacuucccgcgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27279 - RNA, 4033 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagaaagcuuaccauguucguguuccugguccuccugccccuggugagcucccagugcgugaaccuccgcacccggacccagcugccgcccgccuacacgaacagcuucacccgcggcgucuacuaccccgacaagguguuccgguccagcgugcugcacuccacccaggaccucuuccugcccuucuucagcaacgucaccugguuccacgccauccacguguccgggacgaacggcaccaagcgcuucgacaacccggugcugcccuucaacgacggggucuacuucgcgagcaccgagaaguccaacaucauccggggcuggaucuucgggaccacgcucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcaccuucgaguacgugagccagcccuuccugauggaccuggagggcaagcaggggaacuucaagaaccuccgcgaguucguguucaagaacaucgacggcuacuucaagaucuacuccaagcacacgccgaucaaccugguccgggaccugccccagggguucagcgcccucgagccccugguggaccugcccaucggcaucaacaucacccgcuuccagacccuccuggcccugcaccgguccuaccucaccccgggggacagcagcuccggcuggacggcgggcgccgccgccuacuacgugggguaccugcagccccgcaccuuccugcucaaguacaacgagaacggcaccaucaccgacgcggucgacugcgcccuggacccccugagcgagacgaagugcacccucaaguccuucaccguggagaaggggaucuaccagaccagcaacuuccgggugcagcccacggaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccaccuucaagugcuacggcgucagccccacgaagcucaacgaccugugcuucaccaacguguacgccgacuccuucgugauccgcggggacgagguccggcagaucgcccccggccagaccgggaagaucgccgacuacaacuacaagcugccggacgacuucaccggcugcgugaucgcguggaacagcaacaaccucgacuccaaggucgggggcaacuacaacuaccgcuaccggcuguuccgcaagagcaaccugaagcccuucgagcgggacaucuccacggagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccaccaaccuggucaagaacaagugcgugaacuucaacuucaacggccugacggggaccggcgugcucaccgagagcaacaagaaguuccugccguuccagcaguucgggcgcgacaucgccgacaccaccgacgcgguccgggacccccagacgcuggagauccuggacaucacccccugcagcuucggcgggguguccgugaucaccccgggcaccaacacgagcaaccaggucgccgugcucuaccagggcgugaacugcaccgagguccccguggccauccacgccgaccagcugacccccaccuggcgcguguacuccacggggagcaacgucuuccagacccgggccggcugccugaucggggcggagcacgugaacaacuccuacgagugcgacauccccaucggcgccggcaucugcgccagcuaccagacccagaccaacucccgccggcgcgcccggagcguggcgucccagagcaucaucgccuacacgaugucccucggggccgagaacagcgucgccuacuccaacaacagcaucgccaucccgaccaacuucaccaucuccgugaccacggagauccugcccgugagcaugaccaagaccagcgucgacugcaccauguacaucugcggcgacuccacggagugcagcaaccugcuccugcaguacggguccuucugcacccagcugaaccgcgcgcucaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugaccgugcugcccccgcuccugaccgacgagaugaucgcccaguacacgagcgcccugcucgcgggcaccaucaccuccggguggaccuucggcgccggcgccgcccugcagauccccuucgcgaugcagauggccuaccgguucaacgggaucggcgucacgcagaacgugcuguacgagaaccagaagcucaucgccaaccaguucaacagcgccaucgggaagauccaggacucccugagcuccaccgccagcgcgcugggcaagcuccagaacguggucaaccagaacgcccaggcccugaacacccuggugaagcagcucuccagcaacuucggggccaucuccagcgugcugaacgacauccugucccgccucgacccgcccgaggccgagguccagaucgaccggcugaucaccggccgccugcagagccuccagacguacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucaccuacgugcccgcccaggagaagaacuucaccacggcccccgccaucugccacgacggcaaggcccacuucccgcgcgagggggucuucguguccaacggcacccacugguucgugacccagcggaacuucuacgagccccagaucaucaccacggacaacaccuucgucagcggcaacugcgacguggugaucgggaucgucaacaacaccguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugacgaucaugcugugcugcaugaccagcugcugcuccugccucaagggcugcugcagcugcggguccugcugcaaguucgacgaggacgacagcgagcccgugcugaagggcgucaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27280 - RNA, 4018 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccgguccugcccuucaacgacggcguguacuucgcgagcaccgagaaguccaacaucauccgcggguggaucuucggcaccacgcucgacagcaagacccagucccugcugaucgugaacaacgccaccaacgucgugaucaaggugugcgaguuccaguucugcaacgaccccuuccucggggucuacuaccacaagaacaacaagagcuggauggaguccgaguuccggguguacagcuccgccaacaacugcaccuucgaguacgugagccagcccuuccugauggaccuggagggcaagcagggcaacuucaagaaccuccgcgaguucgucuucaagaacaucgacggguacuucaagaucuacuccaagcacacgccgaucaaccuggugcgggaccugccccagggcuucagcgcccucgagccccugguggaccugcccaucgggaucaacaucacccgcuuccagacccuccuggcccugcacgacuccagcagcggcuggaccgcgggggccgccgccuacuacgucggcuaccuccagccgcggacguuccugcugaaguacaacgagaacggcaccaucaccgacgcgguggacugcgcccucgacccccuguccgagaccaagugcacgcucaagagcuucaccguggagaaggggaucuaccagaccuccaacuuccgcguccagcccaccgagagcaucgugcgguuccccaacaucacgaaccucugcccguucggcgaggucuucaacgccacccgcuucgccuccguguacgccuggaaccggaagcgcaucagcaacugcguggcggacuacuccguccuguacaacagcgccuccuucagcaccuucaagugcuacggggugucccccaccaagcugaacgaccucugcuucacgaacguguacgccgacagcuucgucauccggggcgacgaggugcgccagaucgcccccggccagaccgggaagaucgccgacuacaacuacaagcugcccgacgacuucaccggcugcgugaucgcguggaacuccaacaaccuggacagcaaggucgggggcaacuacaacuaccaguaccggcuguuccgcaaguccaaccugaagccguucgagcgggacaucagcaccgagaucuaccaggccggguccacgcccugcaacggcguggagggcuucaacugcuacagcccccugcaguccuacggguuccagcccaccaacggcgugggguaccagccguaccgcgucguggugcucagcuucgagcugcugcacgcccccgccaccgucugcggccccaagaaguccaccaaccucgugaagaacaagugcgugaacuucaacuucaacgggcugacgggcaccggcguccugaccgaguccaacaagaaguuccuccccuuccagcaguucgggcgggacaucgccgacaccaccgacgcggugcgcgacccgcagacgcuggagauccuggacaucacccccugcagcuucggcgggguguccgucaucacccccggcaccaacacgagcaaccagguggccgugcuguaccagggggucaacugcaccgaggugccgguggccauccacgccgaccagcucacccccaccuggcgcgucuacuccacgggcagcaacguguuccagacccgggccggcugccugaucggggcggagcacgugaacaacuccuacgagugcgacauccccaucggcgccgggaucugcgccagcuaccagacccagaccaacagcccccgccgggcccgcagcgucgcgucccagagcaucaucgccuacacgaugucccugggcgccgagaacagcguggccuacuccaacaacagcaucgccaucccgaccaacuucaccaucuccgugaccacggagauccuccccgucagcaugaccaagaccagcguggacugcaccauguacaucugcggcgacuccacggagugcagcaaccugcugcuccaguacggguccuucugcacccagcugaaccgggcgcugaccggcaucgccguggagcaggacaagaacacccaggaggucuucgcccaggugaagcagaucuacaagacgccgcccaucaaggacuucgggggcuucaacuucagccagauccuccccgaccccuccaagcccagcaagcgcuccuucaucgaggaccugcuguucaacaaggugacccucgccgacgccggguucaucaagcaguacggcgacugccugggcgacaucgcggcccgggaccugaucugcgcccagaaguucaacgggcucaacguccugcccccgcugcucaccgacgagaugaucgcccaguacaccagcgcccugcuggcgggcacgaucaccuccggguggaccuucggcgccggggccgcccuccagauccccuucgcgaugcagauggccuaccgcuucaacggcaucggcgugacccagaacgugcuguacgagaaccagaagcugaucgccaaccaguucaacagcgccaucgggaagauccaggacucccucagcuccacggccagcgcgcugggcaagcugcaggacgucgugaaccagaacgcccaggcccucaacacccuggugaagcagcuguccagcaacuucggggccaucuccagcguccucaacgacauccugucccggcuggacccgcccgaggccgaggugcagaucgaccgccucaucaccggccggcugcagagccugcagaccuacgugacgcagcagcucauccgcgcggccgagauccgggccagcgccaaccuggccgcgaccaagauguccgagugcguccuggggcagagcaagcgcguggacuucugcggcaagggcuaccaccucauguccuucccccagagcgcgccccacgggguggucuuccugcacgugaccuacguccccgcccaggagaagaacuucaccaccgcccccgccaucugccacgacggcaaggcccacuucccgcgggaggggguguucguguccaacggcacgcacugguucgucacccagcgcaacuucuacgagccccagaucaucaccaccgacaacacguucgugagcgggaacugcgacguggucaucggcaucgugaacaacaccguguacgacccccugcagcccgagcucgacuccuucaaggaggagcuggacaaguacuucaagaaccacaccagcccggacgucgaccugggcgacaucuccgggaucaacgccagcguggugaacauccagaaggagaucgaccggcucaacgaggucgccaagaaccugaacgagucccugaucgaccuccaggagcugggcaaguacgagcaguacaucaaguggcccugguacaucuggcugggguucaucgccggccucaucgcgaucgugauggugaccaucaugcugugcugcaugacgagcugcugcuccugccugaagggcugcugcagcugcggguccugcugcaaguucgacgaggacgacagcgagcccguccucaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27281 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27282 - RNA, 4039 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagaaagcuuaccauguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccucauggaccuggagggcaagcaggggaacuucaagaaccugcgcgaguucguguucaagaacaucgacggcuacuucaagaucuacuccaagcacacgccgaucaaccucguccgggaccugccccagggguucagcgcccuggagccccucguggaccugcccaucggcaucaacaucacccgcuuccagacccugcucgcccugcaccgguccuaccugacccccgggggcagcagcuccggcuggacggcgggggccgccgccuacuacgugggcuaccuccagccccgcaccuuccugcugaaguacaacgagaacgggaccaucaccgacgcggucgacugcgcccucgacccccugagcgagacgaagugcacccugaaguccuucaccguggagaagggcaucuaccagaccagcaacuuccgggugcagcccacggaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccaccuucaagugcuacggggucagccccacgaagcugaacgaccucugcuucaccaacguguacgccgacuccuucgugauccgcggcgacgagguccggcagaucgcccccgggcagaccggcaagaucgccgacuacaacuacaagcugccggacgacuucaccgggugcgugaucgcguggaacagcaacaaccuggacuccaaggugggcggcaacuacaacuaccucuaccgccuguuccgcaagagcaaccugaagcccuucgagcgggacaucuccacggagaucuaccaggccgggagcacccccugcaacggcgucaagggguucaacugcuacuucccccuccaguccuacggcuuccagccgaccaacggggugggcuaccagcccuaccggguggucgugcugagcuucgagcugcuccacgcccccgccaccgugugcggccccaagaaguccacgaaccuggucaagaacaagugcgugaacuucaacuucaacgggcugaccggcaccggggugcucaccgagagcaacaagaaguuccugccguuccagcaguucggccgcgacaucgccgacaccacggacgcgguccgcgacccccagacccuggagauccuggacaucacccccugcagcuucgggggcguguccgugaucaccccgggcacgaacaccagcaaccaggucgccgugcucuaccagggggugaacugcaccgagguccccguggccauccacgccgaccagcugacccccacguggcggguguacuccaccggcagcaacgucuuccagacccgcgccgggugccugaucggcgcggagcacgugaacaacuccuacgagugcgacauccccaucggcgccgggaucugcgccagcuaccagacccagacgaacuccccgcggcgcgcccggagcguggcgucccagagcaucaucgccuacaccaugucccucggcgucgagaacagcguggccuacuccaacaacagcaucgccauccccaccaacuucaccaucuccgugacgaccgagauccugcccgucagcaugaccaagaccagcguggacugcacgauguacaucugcggggacuccaccgagugcagcaaccugcuccugcaguacggcuccuucugcacccagcugaaccgcgcccucaccgggaucgcgguggagcaggacaagaacacgcaggaggucuucgcccaggugaagcagaucuacaagacgcccccgaucaaggacuucggcggcuucaacuucagccagauccugcccgaccccuccaagcccagcaagcgguccuucaucgaggaccuccuguucaacaaggugacccuggccgacgccggguucaucaagcaguacggcgacugccugggggacaucgccgcgcgcgaccucaucugcgcccagaaguucaacggccugaccguccugccgccccuccugaccgacgagaugaucgcccaguacaccagcgcccugcucgccgggaccaucaccuccggcuggacguucggcgcgggggccgcccugcagauccccuucgccaugcagauggcguaccgguucaacggcaucggggugacccagaacgugcuguacgagaaccagaagcucaucgccaaccaguucaacagcgccaucggcaagauccaggacucccugagcuccaccgccagcgcccuggggaagcuccaggacgucgugaaccagaacgcgcaggcccugaacacccuggugaagcagcucuccagcaacuucggcgccaucuccagcguccugaacgacauccugucccgccucgacccgccggaggccgaggugcagaucgaccggcugaucacgggccgccugcagagccuccagaccuacgugacccagcagcugauccgggccgcggagauccgcgccagcgccaaccuggccgccaccaagauguccgagugcguccucgggcagagcaagcggguggacuucugcggcaagggguaccaccugauguccuucccccagagcgcgccccacggcguggucuuccugcacgugaccuacguccccgcccaggagaagaacuucacgaccgccccggccaucugccacgacgggaaggcgcacuucccccgcgagggcguguucguguccaacggcacccacugguucgucacccagcggaacuucuacgagccccagaucaucacgaccgacaacaccuucgugagcgggaacugcgacguggucaucggcaucgugaacaacaccguguacgacccccuccagccggagcuggacuccuucaaggaggagcuggacaaguacuucaagaaccacacgagccccgacgucgaccucggggacaucuccggcaucaacgccagcguggugaacauccagaaggagaucgaccgccugaacgaggucgccaagaaccugaacgagucccucaucgaccugcaggagcugggcaaguacgagcaguacaucaaguggcccugguacaucuggcucggguucaucgccggccugaucgccaucgugauggugaccaucaugcugugcugcaugaccagcugcugcuccugccucaaggggugcugcagcugcggcuccugcugcaaguucgacgaggacgacagcgagccgguccugaagggggugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27283 - RNA, 4039 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagaaagcuuaccauguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccucauggaccuggagggcaagcaggggaacuucaagaaccugcgcgaguucguguucaagaacaucgacggcuacuucaagaucuacuccaagcacacgccgaucaaccucguccgggaccugccccagggguucagcgcccuggagccccucguggaccugcccaucggcaucaacaucacccgcuuccagacccugcucgcccugcaccgguccuaccugacccccgggggcagcagcuccggcuggacggcgggggccgccgccuacuacgugggcuaccuccagccccgcaccuuccugcugaaguacaacgagaacgggaccaucaccgacgcggucgacugcgcccucgacccccugagcgagacgaagugcacccugaaguccuucaccguggagaagggcaucuaccagaccagcaacuuccgggugcagcccacggaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccaccuucaagugcuacggggucagccccacgaagcugaacgaccucugcuucaccaacguguacgccgacuccuucgugauccgcggcgacgagguccggcagaucgcccccgggcagaccggcaagaucgccgacuacaacuacaagcugccggacgacuucaccgggugcgugaucgcguggaacagcaacaaccuggacuccaaggugggcggcaacuacaacuaccucuaccgccuguuccgcaagagcaaccugaagcccuucgagcgggacaucuccacggagaucuaccaggccgggaacacccccugcaacggcgucgagggguucaacugcuacuucccccuccagagcuacggcuuccagccgaccaacggggugggcuaccagcccuaccggguggucgugcuguccuucgagcugcuccacgcccccgccaccgugugcggccccaagaaguccacgaaccuggucaagaacaagugcgugaacuucaacuucaacgggcugaccggcaccggggugcucaccgagagcaacaagaaguuccugccguuccagcaguucggccgcgacaucgccgacaccacggacgcgguccgcgacccccagacccuggagauccuggacaucacccccugcagcuucgggggcgugagcgugaucaccccgggcacgaacaccuccaaccaggucgccgugcucuaccagggggugaacugcaccgagguccccguggccauccacgccgaccagcugacccccacguggcggguguacagcaccggcuccaacgucuuccagacccgcgccgggugccugaucggcgcggagcacgugaacaacagcuacgagugcgacauccccaucggcgccgggaucugcgccuccuaccagacccagacgaacagcccgcggcgcgcccgguccguggcgagccaguccaucaucgccuacaccaugagccucggcgccgagaacuccgucgccuacagcaacaacuccaucgccauccccaccaacuucaccaucagcgugacgaccgagauccugcccguguccaugaccaagaccagcgucgacugcacgauguacaucugcggggacagcaccgagugcuccaaccugcuccugcaguacggcagcuucugcacccagcugaaccgcgcgcucaccgggaucgccguggagcaggacaagaacacgcaggagguguucgcccaggucaagcagaucuacaagacgcccccgaucaaggacuucggcggcuucaacuucucccagauccugcccgaccccagcaagcccuccaagcggagcuucaucgaggaccuccuguucaacaaggugacccuggccgacgccggguucaucaagcaguacggcgacugccugggggacaucgcggcccgcgaccucaucugcgcccagaaguucaacggccugaccgugcugccgccccuccugaccgacgagaugaucgcccaguacaccuccgcccugcucgcggggaccaucaccagcggcuggacguucggcgccggggccgcccugcagauccccuucgcgaugcagauggccuaccgguucaacggcaucggggucacccagaacgugcuguacgagaaccagaagcucaucgccaaccaguucaacuccgccaucggcaagauccaggacagccuguccagcaccgccuccgcgcuggggaagcuccaggacguggucaaccagaacgcccgcgcccugaacacccuggugaagcagcucagcuccaacuucggcgccaucagcuccgugcugaacgacauccugagccggcucgacccgccggaggccgagguccagaucgaccgccugaucacgggccggcugcagucccuccagaccuacgugacccagcagcugauccgcgcggccgagauccgggccagcgccaaccuggccgcgaccaagaugagcgagugcgugcucgggcaguccaagcgcgucgacuucugcggcaagggguaccaccugaugagcuucccccaguccgcgccccacggcgugguguuccugcacgucaccuacgugcccgcccaggagaagaacuucacgaccgccccggccaucugccacgacgggaaggcccacuucccccgggagggcgucuucgugagcaacggcacccacugguucgugacccagcgcaacuucuacgagccccagaucaucacgaccgacaacaccuucgucuccgggaacugcgacguggugaucggcaucgucaacaacaccguguacgacccccuccagccggagcuggacagcuucaaggaggagcuggacaaguacuucaagaaccacacgucccccgacguggaccucggggacaucagcggcaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggguucaucgccggccugaucgcgaucgucauggugaccaucaugcugugcugcaugaccuccugcugcagcugccucaaggggugcugcuccugcggcagcugcugcaaguucgacgaggacgacuccgagccggugcugaagggggucaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27284 - RNA, 4039 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccucgagggcaagcaggggaacuucaagaaccugcgcgaguucguguucaagaacaucgacggcuacuucaagaucuacuccaagcacaccccgaucaaccugguccgggaccucccccagggguucagcgcccuggagccccugguggaccuccccaucggcaucaacaucacccgcuuccagacccugcuggcccuccaccgguccuaccugacgccgggggacagcagcuccggcuggaccgcgggcgccgccgccuacuacgugggguaccugcagccccgcaccuuccuccugaaguacaacgagaacggcaccaucacggacgcggucgacugcgcccuggacccccucagcgagaccaagugcacccugaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccucuacaacuccgccagcuucuccacguucaagugcuacggcgugagccccaccaagcugaacgaccugugcuucaccaacgucuacgccgacuccuucgugauccgcggggacgaggugcggcagaucgcccccggccagaccgggaagaucgccgacuacaacuacaagcucccggacgacuucacgggcugcgucaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccucagcuucgagcugcugcacgcccccgccacggugugcggccccaagaaguccaccaaccucgugaagaacaagugcgucaacuucaacuucaacggccugaccgggaccggcgugcugaccgagagcaacaagaaguuccugccguuccagcaguucgggcgcgacaucgccgacacgaccgacgcggugcgcgacccccagacccucgagauccuggacaucacccccugcagcuucggcggggucuccgugaucacgccgggcaccaacaccagcaaccagguggccguccuguaccacgacgugaacugcaccgaggugcccgucgccauccacgccgaccagcucacgcccaccuggcggguguacuccaccggcagcaacguguuccagacccgcgccgggugccugaucggcgcggagcacgucaacaacuccuacgagugcgacauccccaucggggccggcaucugcgccagcuaccagacgcagaccaacucccggcgccgggcccgcagcguggcgucccagagcaucaucgccuacaccaugucccugggcgccgagaacagcguggccuacuccaacaacagcaucgccaucccgaccaacuucacgaucuccgucaccaccgagauccuccccgugagcaugaccaagacgagcguggacugcaccauguacaucugcggggacuccaccgagugcagcaaccugcugcuccaguacggcuccuucugcacccagcugaaccgggcgcugacggggaucgccgucgagcaggacaagaacacccaggagguguucgcccaggugaagcagaucuacaagaccccgcccaucaaggacuucggcggguucaacuucagccagauccuccccgaccccuccaagcccagcaagcgcuccuucaucgaggaccugcuguucaacaaggucacccucgccgacgccggcuucaucaagcaguacggcgacugccugggggacaucgcggcccgggaccugaucugcgcccagaaguucaacggccucacggugcugcccccgcugcucaccgacgagaugaucgcccaguacaccagcgcccugcuggcggggaccaucacguccggcuggaccuucggggccggcgccgcccuccagauccccuucgcgaugcagauggccuaccgcuucaacggcaucggggugacccagaacguccuguacgagaaccagaagcugaucgccaaccaguucaacagcgccaucggcaagauccaggacucccucagcuccaccgccagcgcgcuggggaagcugcaggacguggugaaccagaacgcccaggcccucaacacgcuggucaagcagcuguccagcaacuucggcgccaucuccagcgugcucaacgacauccugucccggcuggacccgcccgaggccgaggugcagaucgaccgccucaucaccgggcggcugcagagccugcagaccuacgucacccagcagcucauccgcgcggccgagauccgggccagcgccaaccuggccgcgaccaagauguccgagugcgugcugggccagagcaagcgcguggacuucugcggcaagggguaccaccucauguccuucccccagagcgcgccccacggcgucguguuccugcacgugacguacguccccgcccaggagaagaacuucaccaccgcccccgccaucugccacgacgggaaggcccacuucccgcgggagggcguguucgucuccaacgggacccacugguucgugacgcagcgcaacuucuacgagccccagaucaucaccaccgacaacaccuucgugagcggcaacugcgacgucgugaucggcaucgugaacaacacggucuacgacccccugcagcccgagcucgacuccuucaaggaggagcuggacaaguacuucaagaaccacaccagcccggacguggaccugggggacaucuccggcaucaacgccagcguggucaacauccagaaggagaucgaccggcucaacgagguggccaagaaccugaacgagucccugaucgaccuccaggagcuggggaaguacgagcaguacaucaaguggcccugguacaucuggcugggcuucaucgccggccucaucgcgaucgugauggucaccaucaugcugugcugcaugaccagcugcugcuccugccugaaggggugcugcagcugcggcuccugcugcaaguucgacgaggacgacagcgagcccgugcucaagggggugaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27285 - RNA, 4039 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacuucagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccgccuguuccggaaguccaaccucaagcccuucgagcgcgacaucagcaccgagaucuaccaggccggcuccacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagccggcgccgggcccgcuccguggcgagccaguccaucaucgccuacaccaugagccugggggccgagaacuccgucgccuacagcaacaacuccaucgccaucccgaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgggcgcugacggugaucgccguggagcaggacaagaacacccaggaggucuucgcccaggugaagcagaucuacaagaccccgcccaucaaggacuucggcggguucaacuucucccagauccugcccgaccccagcaagcccuccaagcgcagcuucaucgaggaccuccuguucaacaaggugacccuggccgacgccggcuucaucaagcaguacggcgacugccucggggacaucgcggcccgggaccugaucugcgcccagaaguucaacggccugacgguccugcccccgcuccugaccgacgagaugaucgcccaguacaccuccgcccuccuggcggggaccaucacgagcggcuggaccuucggggccggcgccgcccugcagauccccuucgcgaugcagauggccuaccgcuucaacggcaucggggugacccagaacgugcucuacgagaaccagaagcugaucgccaaccaguucaacuccgccaucggcaagauccaggacagccuguccagcaccgccuccgcgcucgggaagcugcaggacgucgugaaccagaacgcccaggcccugaacacgcucgugaagcagcugagcuccaacuucggcgccaucagcuccguccugaacgacauccucagccggcuggacccgcccgaggccgaggugcagaucgaccgccugaucaccgggcggcuccagucccugcagaccuacgugacccagcagcugauccgcgcggccgagauccgggccagcgccaaccucgccgcgaccaagaugagcgagugcguccugggccaguccaagcgcguggacuucugcggcaagggguaccaccugaugagcuucccccaguccgcgccccacggcguggucuuccuccacgugacguacguccccgcccaggagaagaacuucaccaccgcccccgccaucugccacgacgggaaggcccacuucccgcgggagggcguguucgugagcaacgggacccacugguucgucacgcagcgcaacuucuacgagccccagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccuccccggacgucgaccugggggacaucagcggcaucaacgccuccguggugaacauccagaaggagaucgaccggcugaacgaggucgccaagaaccucaacgagagccugaucgaccugcaggagcucgggaaguacgagcaguacaucaaguggcccugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27286 - RNA, 4021 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagaaagcuuaccauguucguguuccugguccuccugccccuggugagcucccagugcgugaaccucaccacccgcacgcagcugccgagcgccuacaccaacuccuucacccggggcgucuacuaccccgacaagguguuccgcagcuccgugcugcacagcacccaggaccucuuccugcccuucuucuccaacgucacgugguuccacgccaucagcgggaccaacggcaccaagcgguucgacaaccccgugcugccguucaacgacgggguguacuucgcguccaccgagaaguccaacaucauccgcggcuggaucuucgggacgacccucgacagcaagacccagagccugcugaucgucaacaacgccaccaacgccgugaucaaggugugcgaguuccaguucugcaacgaccccuuccucggcgucuaccacaagaacaacaaguccuggauggagagcgaguuccggguguacuccagcgccaacaacugcacguucgaguacgugucccagcccuuccugauggaccuggagggcaagcaggggaacuucaagaaccuccgcgaguucgucuucaagaacaucgacggcuacuucaagaucuacagcaagcacacccccaucaaccuggugcgggaccugccgcagggguucuccgcccucgagccccugguggaccugcccaucggcaucaacaucacccgcuuccagacccucuaccggagcuaccugacgcccggggacagcuccagcggcuggaccgcgggcgccgccgccuacuacgucggguaccugcagccgcgcaccuuccuccugaaguacaacgagaacggcaccaucacggacgcgguggacugcgcccuggacccccucuccgagaccaagugcacccucaagagcuucaccguggagaaggggaucuaccagacguccaacuuccggguccagcccaccgagagcaucgugcgcuuccccaacaucaccaaccugugcccguucggcgagguguucaacgccacccgguucgccuccgucuacgccuggaaccgcaagcggaucagcaacugcguggcggacuacuccguccuguacaacagcgccuccuucagcacguucaagugcuacggcgugucccccaccaagcugaacgaccugugcuucaccaacguguacgccgacagcuucgucauccgcggggacgaggugcggcagaucgcccccggccagaccgggaagaucgccgacuacaacuacaagcuccccgacgacuucacgggcugcgugaucgcguggaacuccaacaaccuggacagcaaggucgggggcaacuacaacuaccuguaccgccucuuccggaaguccaaccugaagccguucgagcgcgacaucagcaccgagaucuaccaggccggcaacacccccugcaacggggugaagggcuucaacugcuacuucccccugcaguccuacggguuccagcccaccaacggcgugggguaccagccguaccgggucguggugcucagcuucgagcugcugcacgcccccgccacggucugcggccccaagaaguccaccaaccucgugaagaacaagugcgugaacuucaacuucaacggccugaccgggaccggcguccugaccgagagcaacaagaaguuccuccccuuccagcaguucgggcgcgacaucgccgacacgaccgacgcggugcgcgacccgcagacccuggagauccuggacaucacccccugcagcuucggcgggguguccgucaucacgcccggcaccaacaccagcaaccagguggccgugcuguaccagggcgucaacugcaccgaggugccgguggccauccacgccgaccagcucacgcccaccuggcgggucuacuccaccgggagcaacguguuccagacccgcgccggcugccugaucggggcggagcacgugaacaacuccuacgagugcgacauccccaucggcgccggcaucugcgccagcuaccagacgcagaccaacucccaccggcgcgcccggagcgucgcgucccagagcaucaucgccuacaccaugucccugggggccgagaacagcguggccuacuccaacaacagcaucgccauccccaccaacuucacgaucuccgugaccaccgagauccucccggucagcaugaccaagacgagcguggacugcaccauguacaucugcggcgacuccaccgagugcagcaaccugcugcuccaguacggguccuucugcacccagcugaaccgcgcgcugacgggcaucgccguggagcaggacaagaacacccaggaggucuucgcccaggugaagcagaucuacaagaccccgcccaucaaggacuucgggggcuucaacuucagccagauccuccccgaccccuccaagcccagcaagcgguccuucaucgaggaccugcuguucaacaaggugacccucgccgacgccggcuucaucaagcaguacggggacugccugggcgacaucgcggcccgcgaccugaucugcgcccagaaguucaacgggcucacgguccugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgugacccagaacgugcuguacgagaaccagaagcugaucgccaaccaguucaacagcgccaucgggaagauccaggacucccucagcuccaccgccagcgcgcugggcaagcugcaggacgucgugaaccagaacgcccaggcccucaacacgcuggugaagcagcuguccagcaacuucggggccaucuccagcguccucaacgacauccugucccgccuggacccgcccgaggccgaggugcagaucgaccggcucaucaccggccgccugcagagccugcagaccuacgugacccagcagcucauccgggcggccgagauccgcgccagcgccaaccuggccgcgaucaagauguccgagugcguccugggccagagcaagcggguggacuucugcgggaagggcuaccaccucauguccuucccccagagcgcgccccacgggguggucuuccugcacgugaccuacgugcccgcccaggagaagaacuucacgaccgcccccgccaucugccacgacggcaaggcccacuucccccgcgagggggucuucguguccaacggcacccacugguucgucacccagcggaacuucuacgagccgcagaucaucacgacccacaacaccuucgugagcggcaacugcgacguggucaucgggaucgugaacaacaccguguacgacccccugcagcccgagcucgacuccuucaaggaggagcuggacaaguacuucaagaaccacacgagccccgacgucgaccugggcgacaucuccgggaucaacgccagcguggugaacauccagaaggagaucgaccgccucaacgaggucgccaagaaccugaacgagucccugaucgaccuccaggagcugggcaaguacgagcaguacaucaaguggccgugguacaucuggcugggcuucaucgccgggcucaucgcgaucgugauggugaccaucaugcugugcugcaugaccagcugcugcuccugccugaagggcugcugcagcugcggguccugcugcaaguucgacgaggacgacagcgagcccguccucaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27287 - RNA, 4042 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcucgacagcaagacccagucccugcugaucgugaacaacgccaccaacguggucaucaaggugugcgaguuccaguucugcaacgaccccuuccucggcgugaccagcaaccacaagaacaacaaguccuggauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacagcuccagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccaccaaguucgccuccgucuacgccuggaaccggaagcgcaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccggcuguuccgcaaguccaaccucaagcccuucgagcgggacaucagcaccgagaucuaccaggccggcuccacccccugcaacggggugaagggcuucaacugcuacuucccccugcagagcuacggguuccagccgaccuacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgggacaucgccgacacgaccgacgcgguccgcgacccccagacccuggagauccucgacaucacccccugcuccuucggcggggugagcgugaucacgccgggcaccaacaccuccaaccaggucgccgugcuguaccagggcgugaacugcaccgagguccccguggccauccacgccgaccagcugacgcccaccuggcgcguguacagcaccggguccaacgucuuccagacccgggccggcugccucaucggggcggagcacgugaacaacagcuacgagugcgacauccccaucggcgccggcaucugcgccuccuaccagacgcagaccaacagccaccgccgggcccgcuccguggcgagccaguccaucaucgccuacaccaugagccugggggccgagaacuccgucgccuacagcaacaacuccaucgccaucccgaccaacuucacgaucagcgugaccaccgagauccugcccgugagcaugaccaagacguccgucgacugcaccauguacaucugcggcgacagcaccgagugcuccaaccuccugcugcaguacgggagcuucugcacccagcucaaccgggcgcugacgggcaucgccguggagcaggacaagaacacccaggagguguucgcccaggucaagcagaucuacaagaccccgcccaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccucggcgacaucgcggcccgggaccugaucugcgcccagaaguucaacgggcugacggugcugcccccgcuccugaccgacgagaugaucgcccaguacaccuccgcccuccuggcgggcaccaucacgagcggguggaccuucggcgccggcgccgcccugcagauccccuucgcgaugcagauggccuaccgcuucaacgggaucggcgucacccagaacgugcucuacgagaaccagaagcugaucgccaaccaguucaacuccgccaucgggaagauccaggacagccuguccagcaccgccuccgcgcucggcaagcugcagaacguggucaaccagaacgcccaggcccugaacacgcucgugaagcagcugagcuccaacuucggggccaucagcuccgugcugaacgacauccucagccggcuggacccgcccgaggccgagguccagaucgaccgccugaucaccggccggcuccagagccugcagaccuacgugacccagcagcugauccgcgcggccgagauccgggccuccgccaaccucgccgcgaccaagaugagcgagugcgugcugggccaguccaagcgcgucgacuucugcgggaagggcuaccaccugaugagcuucccccaguccgcgccccacggggugguguuccuccacgucacguacgugcccgcccaggagaagaacuucaccaccgcccccgccaucugccacgacggcaaggcccacuucccgcgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccugcagcccgagcuggacagcuucaaggaggagcucgacaaguacuucaagaaccacaccuccccggacguggaccugggcgacaucagcgggaucaacgccuccgucgugaacauccagaaggagaucgaccggcugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagcccgugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27288 - RNA, 4048 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggaccgaccgcgaccugccccagggguucagcgcccucgagccccugguggaccugcccaucggcaucaacaucacccgguuccagacgcuccuggcccugcaccgcuccuaccucaccccgggggacagcagcuccggcuggaccgcgggcgccgccgccuacuacgugggguaccugcagccccggaccuuccugcucaaguacaacgagaacggcacgaucaccgacgcggucgacugcgcccuggacccccugagcgagaccaagugcacccucaaguccuucacgguggagaaggggaucuaccagaccagcaacuuccgcgugcagcccaccgaguccaucguccgguucccgaacaucaccaaccugugccccuucggcgagguguucaacgccacgcgcuucgccagcgucuacgccuggaaccggaagcgcaucuccaacugcguggcggacuacagcgugcuguacaacuccgccagcuucuccaccuucaagugcuacggcgucagccccaccaagcucaacgaccugugcuucaccaacguguacgccgacuccuucgugauccgcggggacgagguccggcagaucgcccccggcaagacggggaagaucgccgacuacaacuacaagcugccggacgacuucaccggcugcgugaucgcguggaacagcaacaaccucgacuccaaggucgggggcaacuacaaguaccuguaccggcuguuccgcaagagcaaccucaagcccuucgagcgggacaucuccaccgagaucuaccaggccggcagcacccccugcaacgggguggagggcuucaacugcuacuucccccugcaguccuacggguuccagccgacgaacggcgugggguaccagcccuaccgcguggucgugcugagcuucgagcuccugcacgcccccgccaccgugugcggccccaagaaguccaccaaccuggucaagaacaagugcgugaacuucaacuucaacggccucaccgggaccggcgugcugacggagagcaacaagaaguuccugccguuccagcaguucgggcgcgacaucgccgacaccaccgacgcgguccgggacccccagacccuggagauccucgacaucacgcccugcagcuucggcgggguguccgugaucaccccgggcaccaacaccagcaaccaggucgccgugcuguaccagggcgugaacugcacggagguccccguggccauccacgccgaccagcugacccccaccuggcgcguguacuccaccgggagcaacgucuuccagacgcgggccggcugccucaucggggcggagcacgugaacaacuccuacgagugcgacauccccaucggcgccggcaucugcgccagcuaccagacccagaccaacuccccgcgccgggcccgcagcguggcgucccagagcaucaucgccuacaccaugucccugggggccgagaacagcgucgccuacuccaacaacagcaucgccauccccaucaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccucggcgacaucgcggcccgggaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgcuucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccggcuggacccgcccgaggccgagguccagaucgaccgccugaucaccggccggcuccagagccugcagaccuacgugacccagcagcugauccgcgcggccgagauccgggccagcgccaaccucgccgcgaccaagauguccgagugcgugcugggccagagcaagcgcgucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgggagggggucuucguguccaacggcacccacugguucgugacgcagcgcaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccggcugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27289 - RNA, 4039 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccaccgugugcggccccaagaaguccacgaaccuggucaagaacaagugcgugaacuucaacuucaacggccucaccgggaccggcgugcugaccgagagcaacaagaaguuccugccguuccagcaguucgggcgcgacaucgccgacaccacggacgcgguccgcgacccccagacccuggagauccucgacaucacccccugcagcuucggcgggguguccgugaucaccccgggcacgaacaccagcaaccaggucgccgugcuguaccagggcgugaacugcaccgagguccccguggccauccacgccgaccagcugacccccacguggcggguguacuccaccgggagcaacgucuuccagacccgcgccggcugccucaucggggcggagcacgugaacaacuccuacgagugcgacauccccaucggcgccggcaucugcgccagcuaccagacccagacgaacucccaccggcgcgcccggagcguggcgucccagagcaucaucgccuacaccaugucccugggggccgagaacagcgucgccuacuccaacaacagcaucgccaucccgaccaacuucaccaucuccgugacgaccgagauccugcccgugagcauggcgaagaccagcgucgacugcaccauguacaucugcggcgacuccacggagugcagcaaccuccugcugcaguacggguccuucugcacccagcucaaccgcgcccugaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgguccuucaucgaggaccuccuguucaacaaggugacccuggccgacgcgggcuucaucaagcaguacggggacugccucggcgacaucgccgcccgcgaccugaucugcgcccagaaguucaacgggcugaccgugcugcccccgcuccugaccgacgagaugaucgcccaguacacgagcgcgcuccuggccggcaccaucaccuccggguggaccuucggcgccggcgccgcgcugcagauccccuucgccaugcagauggccuaccgguucaacgggaucggcgucacgcagaacgugcucuacgagaaccagaagcugaucgccaaccaguucaacagcgccaucgggaagauccaggacucccugagcuccaccgcgagcgcccucggcaagcugcaggacguggucaaccagaacgcccaggcccugaacacccucgugaagcagcuguccagcaacuucggggccaucuccagcgugcugaacgacauccucucccgccuggacccgcccgaggcggagguccagaucgaccggcugaucaccggccgccuccagagccugcagacguacgugacccagcagcugauccgggccgccgagauccgcgccagcgccaaccucgcggccaccaagauguccgagugcgugcugggccagagcaagcgggucgacuucugcgggaagggcuaccaccugauguccuucccccagagcgcgccccacggggugguguuccuccacgucaccuacgugcccgcccaggagaagaacuucaccacggcccccgccaucugccacgacggcaaggcccacuucccgcgcgagggggucuucguguccaacggcacccacugguucgugacccagcggaacuucuacgagccccagaucaucaccacggacaacaccuucgucagcggcaacugcgacguggugaucgggaucgucaacaacaccguguacgacccccugcagcccgagcuggacuccuucaaggaggagcucgacaaguacuucaagaaccacaccagcccggacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgcggggcugaucgccaucgucauggugacgaucaugcucugcugcaugaccagcugcugcuccugccugaagggcugcugcagcugcggguccugcugcaaguucgacgaggacgacagcgagcccgugcugaagggcgucaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27290 - RNA, 4039 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacucccaccggcgcgcccggagcguggcgucccagagcaucaucgccuacaccaugucccugggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugacggugcugcccccgcuccugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgcccccgccaucugccacgacggcaaggcccacuucccgcgcaagggggucuucguguccaacggcaccuacugguucgugacgcagcggaacuucuacgagccccagaucaucaccaccgacaacaccuucgucagcggcaacugcgacguggugaucgggaucgucaacaacacgguguacgacccccugcagcccgagcuggacuccuucaaggaggagcucgacaaguacuucaagaaccacaccagcccggacguggaccugggcgacaucuccgggaucaacgccagcuucgucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27291 - RNA, 4033 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguucgacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgugguccacaagaacaacaagagcuggauggaguccgaguuccggguguacagcuccgccaacaacugcacguucgaguacgugagccagcccuuccugauggaccuggagggcaagcagggcaacuucaagaaccuccgcgaguucgucuucaagaacaucgacggguacuucaagaucuacuccaagcacaccccgaucaaccuggugcggggccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgucggguaccugcagccccgcaccuuccugcucaaguacaacgagaacggcaccaucacggacgcgguggacugcgcccuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggcggacuacagcguccuguacaacuccgccagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgcggacacgaccgacgccguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgcgggcugccucaucggggccgaguacgugaacaacuccuacgagugcgacauccccaucggcgccagcaucugcgccuccuaccagacgcagaccaacagcccgcggcgcgcgcgguccguggccagccaguccaucaucgccuacaccaugagccugggcgccgagaacuccgucgccuacagcaacaacuccaucgcgauccccaccaacuucacgaucagcgugaccaccgagauccugcccgugagcaugaccaagacguccgucgacugcaccauguacaucugcggggacagcaccgagugcuccaaccuccugcugcaguacggcagcuucugcacccagcucaaccgcgcccugacggggaucgccguggagcaggacaagaacacccaggagguguucgcccaggucaagcagaucuacaagacgcccccgaucaaggacuucggcggguucaacuucucccagauccugcccgaccccagcaagcccuccaagcggagcuucaucgaggaccuccuguucaacaaggugacccuggccgacgcgggcuucaucaagcaguacggcgacugccucggggacaucgccgcccgcgaccugaucugcgcccagaaguucaacggccugaccgugcucccgccccugcugaccgacgagaugaucgcccaguacaccuccgcgcuccuggccgggaccaucacgagcggcuggaccuucggggccggcgccgcgcugcagauccccuucgccaugcagauggccuaccgguucaacggcaucggggucacccagaacgugcucuacgagaaccagaagcugaucgccaaccaguucaacuccgccaucggcaagauccaggacagccuguccagcaccgcguccgcccucgggaagcugcgcgacguggucaaccagaacgcccaggcccugaacacgcucgugaagcagcugagcuccaacuucggcgccaucagcuccgugcugaacgacauccucagccggcuggacccgcccgaggcggagguccagaucgaccgccugaucaccgggcggcuccagagccugcagaccuacgugacccagcagcugauccgcgccgccgagauccgggccuccgccaaccucgcggccaccaagaugagcgagugcgugcugggccaguccaagcgcgucgacuucugcggcaagggguaccaccugaugagcuucccccaguccgcgccccacggcgugguguuccuccacgucacguacgugcccgcccaggagaagaacuucaccaccgccccggccaucugccacgacgggaaggcccacuucccccgggagggcgucuucgugagcaacgggacccacugguucgugacgcagcgcaacuucuacgagccccagaucaucaccaccgacaacaccuucgucuccggcaacugcgacguggugaucggcaucgucaacaacacgguguacgacccccugcagccggagcuggacagcuucaaggaggagcucgacaaguacuucaagaaccacaccucccccgacguggaccugggggacaucagcggcaucaacgccuccgucgugaacauccagaaggagaucgaccggcuggacgagguggccaagaaccucaacgagagccugaucgaccugcaggagcucgggaaguacgagcaguacaucaaguggcccugguacaucuggcugggcuucaucgcgggccugaucgccaucgucauggugaccaucaugcucugcugcaugaccuccugcugcagcugccugaaggggugcugcuccugcggcagcugcugcaaguucgacgaggacgacuccgagccggugcugaagggggucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27292 - RNA, 4036 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccacgaaccuggucaagaacaagugcgugaacuucaacuucaacggccugaccgggaccggcgugcucaccgagagcaacaagaaguuccugccguuccagcaguucgggcgcgacaucgccgacaccacggacgcgguccgggacccccagacccuggagauccuggacaucacccccugcagcuucggcgggguguccgugaucaccccgggcacgaacaccagcaaccaggucgccgugcucuaccaggacgugaacugcaccgagguccccguggccauccacgccgaccagcugacccccacguggcgcguguacuccaccggcagcaacgucuuccagacccgggccgggugccugaucggcgcggagcacgugaacaacuccuacgagugcgacauccccaucggggccggcaucugcgccagcuaccagacccagacgaacucccgccggcgcgcccggagcguggcgucccagagcaucaucgccuacaccaugucccucggcgccgagaacagcgucgccuacuccaacaacagcaucgccaucccgaccaacuucaccaucuccgugacgaccgagauccugcccgugagcaugaccaagaccagcgucgacugcacgauguacaucugcggggacuccaccgagugcagcaaccugcuccugcaguacggcuccuucugcacccagcugaaccgcgcgcucaccgggaucgccguggagcaggacaagaacacgcaggagguguucgcccaggucaagcagaucuacaagaccccgcccaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccugggggacaucgcggcccgcgaccucaucugcgcccagaaguucaacggccugaccgugcugcccccgcuccugacggacgagaugaucgcccaguacaccagcgcccugcucgcggggaccaucaccuccggcuggacguucggggccggcgccgcccugcagauccccuucgcgaugcagauggccuaccgguucaacggcaucggggucacccagaacgugcuguacgagaaccagaagcucaucgccaaccaguucaacagcgccaucggcaagauccaggacucccugagcuccaccgccagcgcgcuggggaagcuccaggacguggucaaccagaacgcccaggcccugaacacccuggugaagcagcucuccagcaacuucggcgccaucuccagcgugcugaacgacauccugucccgccucgacccgcccgaggccgagguccagaucgaccggcugaucacggggcgccugcagagccuccagaccuacgugacccagcagcugauccgggcggccgagauccgcgccagcgccaaccuggccgcgaccaagauguccgagugcgugcucggccagagcaagcgggucgacuucugcggcaagggguaccaccugauguccuucccccagagcgcgccccacggcgugguguuccugcacgucaccuacgugcccgcccaggagaagaacuucacgaccgcccccgccaucugccacgacgggaaggcccacuucccgcgcgagggcgucuucguguccaacgggacccacugguucgugacccagcggaacuucuacgagccccagaucaucacgaccgacaacaccuucgucagcggcaacugcgacguggugaucggcaucgucaacaacaccguguacgacccccuccagcccgagcuggacuccuucaaggaggagcuggacaaguacuucaagaaccacacgagcccggacguggaccucggggacaucuccggcaucaacgccagcgucgugaacauccagaaggagaucgaccgccugaacgagguggccaagaaccugaacgagucccucaucgaccugcaggagcuggggaaguacgagcaguacaucaaguggcccugguacaucuggcucggcuucaucgccggccugaucgcgaucgucauggugaccaucaugcugugcugcaugaccagcugcugcuccugccucaaggggugcugcagcugcggcuccugcugcaaguucgacgaggacgacagcgagcccgugcugaagggggucaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27293 - RNA, 4033 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagaaagcuuaccauguucguguuccugguccuccugccccuggugagcucccagugcgugaaccuccgcacccggacccagcugccgcccgccuacacgaacagcuucacccgcggcgucuacuaccccgacaagguguuccgguccagcgugcugcacuccacccaggaccucuuccugcccuucuucagcaacgucaccugguuccacgccauccacguguccgggacgaacggcaccaagcgcuucgacaacccggugcugcccuucaacgacggggucuacuucgcgagcaccgagaaguccaacaucauccggggcuggaucuucgggaccacgcucgacagcaagacccagucccugcugaucgugaacaacgccaccaacguggucaucaaggugugcgaguuccaguucugcaacgaccccuuccucggcgugcacaagaacaacaagagcuggauggaguccgaguuccgcgucuacagcuccgccaacaacugcaccuucgaguacgugagccagcccuuccugauggaccuggagggcaagcaggggaacuucaagaaccuccgggaguucguguucaagaacaucgacggcuacuucaagaucuacuccaagcacacgccgaucaaccugguccgcgaccugccccagggguucagcgcccucgagccccugguggaccugcccaucggcaucaacaucacccgguuccagacccuccuggcccugcaccgcuccuaccucaccccgggggacagcagcuccggcuggacggcgggcgccgccgccuacuacgugggguaccugcagccccggaccuuccugcucaaguacaacgagaacggcaccaucaccgacgcggucgacugcgcccuggacccccugagcgagacgaagugcacccucaaguccuucaccguggagaaggggaucuaccagaccagcaacuuccgcgugcagcccacggaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcucaacgaccugugcuucaccaacguguacgccgacuccuucgugauccgcggggacgagguccggcagaucgcccccggccagaccgggaagaucgccgacuacaacuacaagcugccggacgacuucaccggcugcgugaucgcguggaacagcaacaaccucgacuccaaggucgggggcaacuacaacuaccgguaccgccuguuccgcaagagcaaccugaagcccuucgagcgggacaucuccacggagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccaccaaccuggucaagaacaagugcgugaacuucaacuucaacggccugacggggaccggcgugcucaccgagagcaacaagaaguuccugccguuccagcaguucgggcgggacaucgccgacaccaccgacgcgguccgcgacccccagacgcuggagauccuggacaucacccccugcagcuucggcgggguguccgugaucaccccgggcaccaacacgagcaaccaggucgccgugcucuaccagggcgugaacugcaccgagguccccguggccauccacgccgaccagcugacccccaccuggcggguguacuccacggggagcaacgucuuccagacccgcgccggcugccugaucggggcggagcacgugaacaacuccuacgagugcgacauccccaucggcgccggcaucugcgccagcuaccagacccagaccaacucccggcgccgggcccgcagcguggcgucccagagcaucaucgccuacacgaugucccucggggccgagaacagcgucgccuacuccaacaacagcaucgccaucccgaccaacuucaccaucuccgugaccacggagauccugcccgugagcaugaccaagaccagcgucgacugcaccauguacaucugcggcgacuccacggagugcagcaaccugcuccugcaguacggguccuucugcacccagcugaaccgggcgcucaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugaccgugcugcccccgcuccugaccgacgagaugaucgcccaguacacgagcgcccugcucgcgggcaccaucaccuccggguggaccuucggcgccggcgccgcccugcagauccccuucgcgaugcagauggccuaccgcuucaacgggaucggcgucacgcagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacccuggugaagcagcucuccagcaacuucggggccaucuccagcgugcugaacgacauccugucccggcucgacccgcccgaggccgagguccagaucgaccgccugaucaccggccggcugcagagccuccagacguacgugacccagcagcugauccgcgcggccgagauccgggccagcgccaaccuggccgcgaccaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucaccacggcccccgccaucugccacgacggcaaggcccacuucccgcgggagggggucuucguguccaacggcacccacugguucgugacccagcgcaacuucuacgagccccagaucaucaccacggacaacaccuucgucagcggcaacugcgacguggugaucgggaucgucaacaacaccguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugacgaucaugcugugcugcaugaccagcugcugcuccugccucaagggcugcugcagcugcggguccugcugcaaguucgacgaggacgacagcgagcccgugcugaagggcgucaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27294 - RNA, 4030 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27295 - RNA, 4030 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27296 - RNA, 4030 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccgcgaccuguuccugcccuucuucagcaacgugaccugguuccacgugaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccacaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacucugggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27297 - RNA, 4030 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgugaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccacaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacucugggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27298 - RNA, 4039 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27299 - RNA, 4039 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27300 - RNA, 4039 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27301 - RNA, 4039 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggaugaagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcgugcagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccacgagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27302 - RNA, 4033 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagaaagcuuaccauguucguguuccuggugcugcugccccuggugagcagccagugcgugaaccugcgcacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgagguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcagaacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27303 - RNA, 4018 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacgugaucaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcacgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccaguaccggcuguuccggaagagcaaccugaagcccuucgagcgggacaucagcaccgagaucuaccaagccggcuccaccccuugcaacggcguggagggcuucaacugcuacagcccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaacgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27304 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27305 - RNA, 4039 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagaaagcuuaccauguucguguucuucgugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcggcagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27306 - RNA, 4039 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagaaagcuuaccauguucguguucuucgugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcggcagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccgcgcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27307 - RNA, 4039 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgagcugcggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcuuccuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccacgacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27308 - RNA, 4039 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacuucagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccgugaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27309 - RNA, 4021 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagaaagcuuaccauguucguguuccuggugcugcugccccuggugagcagccagugcgugaaccugaccacccggacccagcugccaagcgccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacgccgugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccuguaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27310 - RNA, 4042 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcgugaccagcaaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccaccaaguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcagaacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27311 - RNA, 4048 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggaccgaccgcgaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggcaagacaggcaagaucgccgacuacaacuacaagcugcccgacgacuucaccggcugcgugaucgccuggaacagcaacaaccucgacagcaaggugggcggcaacuacaaguaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27312 - RNA, 4039 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcauggccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27313 - RNA, 4039 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccggaagggcguguucgugagcaacggcaccuacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27314 - RNA, 4033 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguucgacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugguggugcacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgccgagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccagcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcgcgacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcuggacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27315 - RNA, 4036 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27316 - RNA, 4033 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagaaagcuuaccauguucguguuccuggugcugcugccccuggugagcagccagugcgugaaccugcgcacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcgugcacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27317 - RNA, 4030 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27318 - RNA, 4030 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccauuugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27319 - RNA, 4030 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccgggaccuguuccugcccuucuucagcaacgugaccugguuccacgugaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgccaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugagggaccugccccagggauucagcgcucuggagccucugguggaccugcccaucggcaucaacaucacccgguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccacaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaggagguguucgcccaggugaagcaaaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggacccugggcgccggcgccgcacugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagccggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccucaugagcuuuccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27320 - RNA, 4030 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgugaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgccaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcucuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccacaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaggagguguucgcccaagugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggacccugggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccucaugagcuuuccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27321 - RNA, 4039 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcuucgugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27322 - RNA, 4039 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcuucgugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27323 - RNA, 4039 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27324 - RNA, 4039 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggaugaaguccgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacggugugcagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaagacaagaacacccaggagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccacgagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27325 - RNA, 4033 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagaaagcuuaccauguucguguuccuggugcugcugccccuggugagcagccagugcgugaaccugcggacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcguguacuaccacaagaacaacaagagcuggauggagagcgaggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuucaacugcuacuuuccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacaccagcaaccagguggccgugcuguaccagggagugaacugcacagaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugacugugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcagaacguggugaaccagaacgcucaggcccugaacacccuggugaagcagcugagcagcaauuucggcgccaucagcucagugcugaacgacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuuuccccagagcgcuccccacggcgugguguuccugcacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27326 - RNA, 4018 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacgugaucaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgucuacuaccacaagaacaacaagagcuggauggagagcgaguuccggguguacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggcuucagcgcccuggagccucugguggaccugcccaucggaaucaacaucaccagguuccagacccugcuggcccugcacgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcauugugcgguuccccaacaucaccaaccugugucccuucggcgagguguucaacgccacucgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaagaucgccgacuacaacuacaagcugcccgacgacuucaccggcugcgugaucgccuggaacagcaacaaccuggacagcaaggugggcggcaacuacaacuaccaguaccggcuguuccguaagagcaaccugaagcccuucgagcgggacaucagcaccgagaucuaccaggccggcagcaccccaugcaacggcguggagggcuuuaacugcuacagcccccugcagagcuacgguuuccagcccaccaacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggauaucgccgacaccaccgacgcagugcgggacccccagacccuggagauccuggacaucacccccugcagcuucggcggcgucagcgugaucaccccaggcaccaacaccagcaaccagguggccgugcuguaccagggcgugaacugcacagaggugcccguggccauccacgccgaccagcugacccccaccuggcggguguacagcaccggcagcaacguguuccagacccgggccggaugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccauaagcgugaccaccgagauccugccugugagcaugaccaagaccagcguggacuguaccauguacaucugcggcgacagcaccgagugcagcaacuuacugcugcaguacggcagcuucugcacccagcugaaccgggcccugaccggcaucgccguggagcaagacaagaacacccaggagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgccgcucgggaccugaucugcgcccagaaguucaacggccugaacgugcugccuccccugcugacugacgagaugaucgcccaguacaccagcgcccugcuggccgggaccaucaccagcggcuggaccuucggcgccggcgcagcccugcagauccccuucgccaugcagauggccuaccgguucaacggcaucggcgugacccagaacgugcuuuacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcucagugcugaacgacauccugagccggcuggacccacccgaggccgaggugcagaucgacaggcugaucaccggccggcugcagagccugcagaccuacgugacccagcagcugauccgggccgccgagauucgggccagcgccaaccuggcagccaccaagaugagcgagugcgugcugggccagagcaagcggguggacuucugcggcaagggcuaccaccugaugagcuuuccccagagcgcuccccacggcgugguguuccugcacgucaccuacgugcccgcccaggagaagaacuucaccaccgcccccgccaucugccacgacggcaaggcccacuucccccgggagggcguguucgugagcaacggcacacacugguucgugacccagcggaacuucuacgagccccagaucaucaccaccgacaacaccuucgugagcggaaacugcgacguggugaucggcaucgugaacaacaccguguacgacccucugcagcccgagcucgacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27327 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27328 - RNA, 4039 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagaaagcuuaccauguucguguucuucgugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuuuggcaccacccuggacagcaagacccagagccugcugaucgugaacaacgccacaaacguggugaucaaggugugcgaguuccaguucugcaacgaccccuuccugggcguguacuaccacaagaacaacaagagcuggauggagagcgaguuccgggucuacagcagcgcuaacaauugcaccuucgaguacgugagccagcccuuccugauggaccuggagggcaagcagggcaacuucaagaaccuccgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcggcagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcauugugcgguuccccaacaucacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccgguagcacccccugcaacggcgugaagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgauaccaccgacgcagugcgggacccccagacccuggagauccuggacaucaccccaugcagcuucggcggcgugagcgucaucacccccggaaccaacacaagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagaucuuacccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaucugaucugcgcucagaaguucaacggccugaccgugcugcccccucugcugaccgacgagaugaucgcccaguacaccagcgcccugcuggccggcaccaucaccagcggcuggaccuucggcgccggcgccgcacuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucaccuacgugcccgcccaggagaagaacuucacaaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27329 - RNA, 4039 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagaaagcuuaccauguucguguucuucgugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuuuggcaccacccuggacagcaagacccagagccugcugaucgugaacaacgccacaaacguggugaucaaggugugcgaguuccaguucugcaacgaccccuuccugggcguguacuaccacaagaacaacaagagcuggauggagagcgaguuccgggucuacagcagcgcuaacaauugcaccuucgaguacgugagccagcccuuccugauggaccuggagggcaagcagggcaacuucaagaaccuccgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcggcagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcauugugcgguuccccaacaucacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccgguaacacccccugcaacggcguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggacaucgccgauaccaccgacgcagugcgggacccccagacccuggagauccuggacaucaccccaugcagcuucggcggcgugagcgucaucacccccggaaccaacacaagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcucgggaucugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcuagggcccugaacacccuggugaagcagcugagcagcaauuuuggcgccaucagcagcgugcugaacgacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27330 - RNA, 4039 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgagcugcgggucuacagcagcgcuaacaauugcaccuucgaguacgugagccagcccuuccucauggaccuggagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcuuccuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccacgacgugaacugcaccgaggugcccguggccauccacgccgaccagcugacccccaccuggcggguguacagcaccggaagcaacguguuccagacccgggccggcugcuuaaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaggagguguucgcccaagugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugccuccccugcugaccgacgagaugaucgcccaguacaccagcgcccuucuggccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccucaugagcuucccccagagcgcuccccacggcgugguguuccugcacgugacauacgugcccgcccaggagaagaacuucaccaccgcccccgccauuugccacgacggcaaggcccacuucccccgggagggcgucuucgugagcaacggaacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27331 - RNA, 4039 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacuucagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagccggcggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccgugaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgccgcucgggaccugaucugcgcccagaaguucaacgggcugaccgugcugccuccccugcugaccgacgagaugaucgcccaguacaccagcgcccugcuugccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcagcgugcugaaugacauccugucacggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27332 - RNA, 4021 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagaaagcuuaccauguucguguuccuggugcugcugccccuggugagcagccagugcgugaaccugaccacccggacccagcugcccagcgccuacaccaacagcuucacccggggcguguacuacccugacaagguguuccggagcagcgugcugcacagcacccaggaccuguuccugcccuucuucagcaacgugaccugguuccacgccaucagcggcaccaacggcaccaagcgguucgacaaccccgugcugccauucaacgacggcguguacuucgccagcaccgagaagucaaacaucauccggggcuggaucuucggcaccacccuggacagcaagacacagagccugcugaucgugaacaacgccaccaacgcugugaucaaggugugcgaguuucaguucugcaacgaccccuuccugggcguguaccacaagaacaacaagagcuggauggagagcgaguuccggguguacagcagcgccaacaauugcaccuucgaguacgugagccagcccuuccugauggaccucgagggcaagcagggcaacuucaagaaccugcgggaguucgucuucaagaacaucgauggcuacuucaagaucuacagcaagcacacccccaucaaccuggugcgggaccugccccagggauucagcgcccuggagccccugguggaccugccuaucggcaucaacaucaccagguuccagacccuguaccggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuucgagcgggacaucagcaccgagaucuaccaggccggcaacaccccaugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggccccaaaaagagcaccaaccuggugaagaacaagugcgugaauuucaacuucaacggccugaccggcaccggcgugcugaccgagagcaacaagaaguuccugccuuuccagcaguucggccgggauaucgccgacaccaccgacgcagugcgggacccccagacccuggagauccuggacaucacccccugcagcuucggcggcgugagcgugaucaccccaggcacaaacaccagcaaccagguggccguccuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagccugggcgccgagaacagcguggccuacagcaacaacagcaucgcgauccccaccaacuucaccaucagcgugaccaccgagauacugcccgugagcaugaccaagaccagcguggacuguaccauguacaucugcggcgacagcaccgagugcagcaacuuacugcugcaguacggcagcuucugcacccagcugaaccgggcccugaccggcaucgccguggagcaggacaagaacacccaagagguguucgcccaggugaagcagaucuacaagacuccucccaucaaggacuucggcggcuucaacuucagccagauccugcccgacccaagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccugcagauccccuucgccaugcagauggccuaccgguucaacggcaucggcgugacccagaacgugcuuuacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcucagugcugaacgacauccugagcaggcuggacccacccgaggccgaggugcagaucgaccggcugaucaccggccggcugcagagccugcagaccuacgugacccagcagcugauccgggccgccgagauccgggccagcgccaaccuggcagccauuaagaugagcgagugcgugcugggccagagcaagcggguggacuuuugcggcaagggcuaccaccugaugagcuucccccagagcgcuccccacggcgugguguuccugcacgugaccuacgugcccgcccaggagaagaacuucacaaccgcccccgccaucugccacgacggcaaggcccacuucccccgggagggaguguucgucagcaacggcacccacugguucgugacccagcggaacuucuacgagccccagaucaucaccacccacaacaccuucgugagcggcaacugcgacguggugaucggcaucgugaacaacaccguguacgacccccugcagccugagcucgacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27333 - RNA, 4042 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgugaccagcaaccacaagaacaacaagagcuggauggagagcgaguuccgggucuacagcagcgcuaauaacugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcauugugcgguuccccaacaucaccaaccugugucccuucggcgagguguucaacgccaccaaguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcuccaacguguuccagacccgggccggcugccugaucggcgccgagcacgugaacaacagcuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcagaacguggugaaccagaacgcucaggcccugaacacccuggugaagcagcugagcagcaauuucggcgccaucucaagcgugcugaacgacauccugagccggcuggacccacccgaggccgaggugcagaucgacaggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27334 - RNA, 4048 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcggaccgacagggaccugccccagggauucagcgcccuggagccucugguggaccugcccaucggcaucaacaucacccgguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagacuagcaacuuccgggugcagcccaccgagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggcaagaccggcaagaucgccgacuacaacuacaagcugcccgacgacuucaccggcugcgugaucgccuggaacagcaacaaccuggacagcaaggugggcggcaacuacaaguaccuguaccggcuguuccguaagagcaaccugaagccauucgagcgggauaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggacaucgccgacaccaccgacgcagugcgggacccccagacccuggagauccuggacaucaccccaugcagcuucggcggcgugagcgucaucacacccggcaccaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaucaacuucaccauaagcgugaccaccgagauccugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaggagguguucgcccaagugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggggacaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagccggcuggaucccccagaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27335 - RNA, 4039 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacacaagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcauggccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgcugcccgggaccugaucugcgcccagaaguucaacggccugacugugcugccuccccugcugaccgacgagaugaucgcccaguacaccagcgcccugcuugccggcaccaucaccagcggcuggaccuucggcgcaggcgccgcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcucugggcaagcugcaggacguggugaaccagaacgcccaggcccugaacacccuggugaagcagcugagcagcaacuucggcgccaucagcucagugcugaaugacauccugagcaggcuggacccacccgaggccgaggugcagaucgaccggcugaucaccggccggcugcagagccugcagaccuacgugacccagcagcugauccgggccgccgagauccgggccagcgcaaaccuggccgccaccaagaugagcgagugcgugcugggccagagcaagcggguggacuuuugcggcaagggcuaccaccugaugagcuucccccagagcgcuccccacggcgugguguuccuccacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27336 - RNA, 4039 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacccacccgaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccggaagggaguguucgugagcaacggcaccuacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcuucgugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27337 - RNA, 4033 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguucgacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccuggugguccacaagaacaacaagagcuggauggagagcgaguuccggguguacagcagcgcuaacaauugcaccuucgaguacgugagccagcccuuccugauggaucucgagggcaagcagggcaacuucaagaaccugcgggaguucguguucaagaacaucgacggcuacuucaagaucuacagcaagcacacccccaucaaccuggugcggggccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugccgagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgcagacaccaccgacgccgugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgcugaguacgugaacaacuccuacgagugcgacauccccaucggcgccagcaucugcgccagcuaccagacccagaccaacagcccccggcgggcccggagcguggccagccagagcaucaucgccuacaccaugagcuuaggcgccgagaacagcguggcguacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgcugcccgggaccugaucugcgcccagaaguucaacgggcugaccgugcugcccccucugcugaccgacgagaugaucgcccaguacaccagcgcccugcuugccggcaccaucaccagcggcuggaccuucggcgcaggcgccgcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcucugggcaagcugagggacguggugaaccagaacgcccaggcccugaacacccuggugaagcagcugagcagcaacuucggcgccaucucaagcgugcugaaugacauccugagccggcuggaucccccagaggccgaggugcagaucgaccggcugaucaccggccggcugcagagccugcagaccuacgugacccagcagcugauccgggccgccgagauccgggccagcgcaaaccuggccgccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcuggacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27338 - RNA, 4036 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacacaagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggcgacaucgccgcuagggaccugaucugcgcccagaaguucaacgggcugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugaccuacguccccgcccaggagaagaacuucacaaccgcccccgccauuugccacgacggcaaggcccacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27339 - RNA, 4033 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagaaagcuuaccauguucguguuccuggugcugcugccccuggugagcagccagugcgugaaccugcggacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgugcacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugagggaccugccccagggauucagcgcccuggagccucugguggaccugcccaucggcaucaacaucacccgguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacaccagcaaccagguggccgugcuguaccagggagugaacugcacagaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagaggagcuucaucgaggaccugcuguucaacaaggugacccuggccgacgccggcuucaucaagcaguacggcgacugccugggggauaucgccgcucgggaccugaucugcgcccagaaguucaacggccugacugugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27340 - RNA, 4030 nt, Artificial Sequence
  SARS-CoV-2/Wuhan/WIV05/2019__EPI_ISL_402128 spike protein mRNA gc mod (1-1273)(K986P_V987P_H69del_V70del_Y144del_E484K_N501Y_A570D_D614 G_P681H_T716I_S982A_D1118H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27341 - RNA, 4030 nt, Artificial Sequence
  SARS-CoV-2/Wuhan/WIV05/2019__EPI_ISL_402128 spike protein mRNA gc mod (1-1273)(K986P_V987P_L18F_D80A_D215G_L242del_A243del_L244del_K417 N_E484K_N501Y_D614G_A701V)
aggagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27342 - RNA, 4030 nt, Artificial Sequence
  SARS-CoV-2/Wuhan/WIV05/2019__EPI_ISL_402128 spike protein mRNA gc mod (1-1273)(K986P_V987P_Q52R_A67V_H69del_V70del_Y144del_E484K_D614G_ Q677H_F888L)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccgcgaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacacacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27343 - RNA, 4030 nt, Artificial Sequence
  SARS-CoV-2/Wuhan/WIV05/2019__EPI_ISL_402128 spike protein mRNA gc mod (1-1273)(K986P_V987P_A67V_H69del_V70del_Y144del_E484K_D614G_Q677H _F888L)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacacacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27344 - RNA, 4039 nt, Artificial Sequence
  SARS-CoV-2/Wuhan/WIV05/2019__EPI_ISL_402128 spike protein mRNA gc mod (1-1273)(K986P_V987P_L18F_T20N_P26S_D138Y_R190S_K417T_E484K_N501Y _D614G_H655Y_T1027I_V1176F)
aggagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27345 - RNA, 4039 nt, Artificial Sequence
  SARS-CoV-2/Wuhan/WIV05/2019__EPI_ISL_402128 spike protein mRNA gc mod (1-1273)(K986P_V987P_E484K_D614G_V1176F)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27346 - RNA, 4039 nt, Artificial Sequence
  SARS-CoV-2/Wuhan/WIV05/2019__EPI_ISL_402128 spike protein mRNA gc mod (1-1273)(K986P_V987P_L452R_D614G_P681R)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27347 - RNA, 4039 nt, Artificial Sequence
  SARS-CoV-2/Wuhan/WIV05/2019__EPI_ISL_402128 spike protein mRNA gc mod (1-1273)(K986P_V987P_E154K_L452R_E484Q_D614G_P681R_Q1071H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggaugaagagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcgugcagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucacgagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27348 - RNA, 4033 nt, Artificial Sequence
  SARS-CoV-2/Wuhan/WIV05/2019__EPI_ISL_402128 spike protein mRNA gc mod (1-1273)(K986P_V987P_T19R_F157del_R158del_L452R_T478K_D614G_P681R _D950N)
aggagaaagcuuaccauguucguguuucuggugcugcugccccugguguccagccagugugugaaccugcgcaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27349 - RNA, 4018 nt, Artificial Sequence
  SARS-CoV-2/Wuhan/WIV05/2019__EPI_ISL_402128 spike protein mRNA gc mod (1-1273)(K986P_V987P_G75V_T76I_R246del_S247del_Y248del_L249del_T2 50del_P251del_G252del_L452Q_F490S_D614G_T859N)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaaugugaucaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccaguaccggcuguuccggaaguccaaucugaagcccuucgagcgggacaucagcaccgaaaucuaucaggccggcagcaccccuugcaacggcguggaaggcuucaacugcuacagcccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugaacgugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27350 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_N439K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27351 - RNA, 4039 nt, Artificial Sequence
  SARS-CoV-2/Wuhan/WIV05/2019__EPI_ISL_402128 spike protein mRNA gc mod (1-1273)(K986P_V987P_L5F_T95I_D253G_E484K_D614G_A701V)
aggagaaagcuuaccauguucguguuuuucgugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27352 - RNA, 4039 nt, Artificial Sequence
  SARS-CoV-2/Wuhan/WIV05/2019__EPI_ISL_402128 spike protein mRNA gc mod (1-1273)(K986P_V987P_L5F_T95I_D253G_S477N_D614G_Q957R)
aggagaaagcuuaccauguucguguuuuucgugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccgcgcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27353 - RNA, 4039 nt, Artificial Sequence
  SARS-CoV-2/Wuhan/WIV05/2019__EPI_ISL_402128 spike protein mRNA gc mod (1-1273)(K986P_V987P_F157L_V367F_Q613H_P681R)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagcugcggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccuuccuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccacgacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27354 - RNA, 4039 nt, Artificial Sequence
  SARS-CoV-2/Wuhan/WIV05/2019__EPI_ISL_402128 spike protein mRNA gc mod (1-1273)(K986P_V987P_S254F_D614G_P681R_G769V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauuucagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagugaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27355 - RNA, 4021 nt, Artificial Sequence
  SARS-CoV-2/Wuhan/WIV05/2019__EPI_ISL_402128 spike protein mRNA gc mod (1-1273)(K986P_V987P_P26S_H69del_V70del_V126A_Y144del_L242del_A24 3del_L244del_H245Y_S477N_E484K_D614G_P681H_T1027I_D1118H)
aggagaaagcuuaccauguucguguuucuggugcugcugccccugguguccagccagugugugaaccugaccaccagaacacagcugccuagcgccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacgccgucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacuguacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27356 - RNA, 4042 nt, Artificial Sequence
  SARS-CoV-2/Wuhan/WIV05/2019__EPI_ISL_402128 spike protein mRNA gc mod (1-1273)(K986P_V987P_T95I_Y144T_Y145S_ins145N_R346K_E484K_N501Y_D 614G_P681H_D950N)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucaccagcaaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccaaguucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27357 - RNA, 4048 nt, Artificial Sequence
  SARS-CoV-2/Wuhan/WIV05/2019__EPI_ISL_402128 spike protein mRNA gc mod (1-1273)(K986P_V987P_ins214TDR_Q414K_N450K_D614G_T716I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggaccgaccgcgaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggaaagacaggcaagaucgccgacuacaacuacaagcugcccgacgacuucaccggcugugugauugccuggaacagcaacaaccuggacuccaaagucggcggcaacuacaaguaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27358 - RNA, 4039 nt, Artificial Sequence
  SARS-CoV-2/Wuhan/WIV05/2019__EPI_ISL_402128 spike protein mRNA gc mod (1-1273)(K986P_V987P_T478K_D614G_P681H_T732A)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccauggccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27359 - RNA, 4039 nt, Artificial Sequence
  SARS-CoV-2/Wuhan/WIV05/2019__EPI_ISL_402128 spike protein mRNA gc mod (1-1273)(K986P_V987P_E484K_N501Y_D614G_P681H_E1092K_H1101Y_V1176F )
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagaaagggcguguucguguccaacggcaccuacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27360 - RNA, 4033 nt, Artificial Sequence
  SARS-CoV-2/Wuhan/WIV05/2019__EPI_ISL_402128 spike protein mRNA gc mod (1-1273)(K986P_V987P_H66D_G142V_Y144del_Y145del_D215G_V483A_D614G _H655Y_G669S_Q949R_N1187D)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguucgacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccuggugguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgccgaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuagcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcgcgacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcuggacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27361 - RNA, 4036 nt, Artificial Sequence
  SARS-CoV-2/Wuhan/WIV05/2019__EPI_ISL_402128 spike protein mRNA gc mod (1-1273)(K986P_V987P_Y144del_L452R_T478K_P681R)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27362 - RNA, 4033 nt, Artificial Sequence
  SARS-CoV-2/Wuhan/WIV05/2019__EPI_ISL_402128 spike protein mRNA gc mod (1-1273)(K986P_V987P_T19R_Y144del_Y145del_L452R_T478K_D614G_P681R )
aggagaaagcuuaccauguucguguuucuggugcugcugccccugguguccagccagugugugaaccugcgcaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27363 - RNA, 4030 nt, Artificial Sequence
  SARS-CoV-2/Wuhan/WIV05/2019__EPI_ISL_402128 spike protein mRNA gc mod (1-1273)(K986P_V987P_H69del_V70del_Y144del_E484K_N501Y_A570D_D614 G_P681H_T716I_S982A_D1118H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27364 - RNA, 4030 nt, Artificial Sequence
  SARS-CoV-2/Wuhan/WIV05/2019__EPI_ISL_402128 spike protein mRNA gc mod (1-1273)(K986P_V987P_L18F_D80A_D215G_L242del_A243del_L244del_K417 N_E484K_N501Y_D614G_A701V)
aggagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27365 - RNA, 4030 nt, Artificial Sequence
  SARS-CoV-2/Wuhan/WIV05/2019__EPI_ISL_402128 spike protein mRNA gc mod (1-1273)(K986P_V987P_Q52R_A67V_H69del_V70del_Y144del_E484K_D614G_ Q677H_F888L)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccgcgaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacacacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27366 - RNA, 4030 nt, Artificial Sequence
  SARS-CoV-2/Wuhan/WIV05/2019__EPI_ISL_402128 spike protein mRNA gc mod (1-1273)(K986P_V987P_A67V_H69del_V70del_Y144del_E484K_D614G_Q677H _F888L)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacacacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27367 - RNA, 4039 nt, Artificial Sequence
  SARS-CoV-2/Wuhan/WIV05/2019__EPI_ISL_402128 spike protein mRNA gc mod (1-1273)(K986P_V987P_L18F_T20N_P26S_D138Y_R190S_K417T_E484K_N501Y _D614G_H655Y_T1027I_V1176F)
aggagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27368 - RNA, 4039 nt, Artificial Sequence
  SARS-CoV-2/Wuhan/WIV05/2019__EPI_ISL_402128 spike protein mRNA gc mod (1-1273)(K986P_V987P_E484K_D614G_V1176F)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27369 - RNA, 4039 nt, Artificial Sequence
  SARS-CoV-2/Wuhan/WIV05/2019__EPI_ISL_402128 spike protein mRNA gc mod (1-1273)(K986P_V987P_L452R_D614G_P681R)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27370 - RNA, 4039 nt, Artificial Sequence
  SARS-CoV-2/Wuhan/WIV05/2019__EPI_ISL_402128 spike protein mRNA gc mod (1-1273)(K986P_V987P_E154K_L452R_E484Q_D614G_P681R_Q1071H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggaugaagagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcgugcagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucacgagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27371 - RNA, 4033 nt, Artificial Sequence
  SARS-CoV-2/Wuhan/WIV05/2019__EPI_ISL_402128 spike protein mRNA gc mod (1-1273)(K986P_V987P_T19R_F157del_R158del_L452R_T478K_D614G_P681R _D950N)
aggagaaagcuuaccauguucguguuccuggugcugcugccucugguguccagccagugugugaaccugcgcaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27372 - RNA, 4018 nt, Artificial Sequence
  SARS-CoV-2/Wuhan/WIV05/2019__EPI_ISL_402128 spike protein mRNA gc mod (1-1273)(K986P_V987P_G75V_T76I_R246del_S247del_Y248del_L249del_T2 50del_P251del_G252del_L452Q_F490S_D614G_T859N)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaaugugaucaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccaguaccggcuguuccggaaguccaaucugaagcccuucgagcgggacaucuccaccgagaucuaucaggccggcagcaccccuuguaacggcguggaaggcuucaacugcuacagcccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugaacgugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27373 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_N439K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27374 - RNA, 4039 nt, Artificial Sequence
  SARS-CoV-2/Wuhan/WIV05/2019__EPI_ISL_402128 spike protein mRNA gc mod (1-1273)(K986P_V987P_L5F_T95I_D253G_E484K_D614G_A701V)
aggagaaagcuuaccauguucguguucuucgugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27375 - RNA, 4039 nt, Artificial Sequence
  SARS-CoV-2/Wuhan/WIV05/2019__EPI_ISL_402128 spike protein mRNA gc mod (1-1273)(K986P_V987P_L5F_T95I_D253G_S477N_D614G_Q957R)
aggagaaagcuuaccauguucguguucuucgugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccgcgcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27376 - RNA, 4039 nt, Artificial Sequence
  SARS-CoV-2/Wuhan/WIV05/2019__EPI_ISL_402128 spike protein mRNA gc mod (1-1273)(K986P_V987P_F157L_V367F_Q613H_P681R)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagcugcggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccuuccuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccacgacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27377 - RNA, 4039 nt, Artificial Sequence
  SARS-CoV-2/Wuhan/WIV05/2019__EPI_ISL_402128 spike protein mRNA gc mod (1-1273)(K986P_V987P_S254F_D614G_P681R_G769V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauuucagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagugaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27378 - RNA, 4021 nt, Artificial Sequence
  SARS-CoV-2/Wuhan/WIV05/2019__EPI_ISL_402128 spike protein mRNA gc mod (1-1273)(K986P_V987P_P26S_H69del_V70del_V126A_Y144del_L242del_A24 3del_L244del_H245Y_S477N_E484K_D614G_P681H_T1027I_D1118H)
aggagaaagcuuaccauguucguguuccuggugcugcugccucugguguccagccagugugugaaccugaccaccagaacacagcugccuagcgccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacgccgucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacuguacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27379 - RNA, 4042 nt, Artificial Sequence
  SARS-CoV-2/Wuhan/WIV05/2019__EPI_ISL_402128 spike protein mRNA gc mod (1-1273)(K986P_V987P_T95I_Y144T_Y145S_ins145N_R346K_E484K_N501Y_D 614G_P681H_D950N)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucaccagcaaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccaaguucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27380 - RNA, 4048 nt, Artificial Sequence
  SARS-CoV-2/Wuhan/WIV05/2019__EPI_ISL_402128 spike protein mRNA gc mod (1-1273)(K986P_V987P_ins214TDR_Q414K_N450K_D614G_T716I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggaccgaccgcgaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggaaagacaggcaagaucgccgacuacaacuacaagcugcccgacgacuucaccggcugugugauugccuggaacagcaacaaccuggacuccaaagucggcggcaacuacaaguaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27381 - RNA, 4039 nt, Artificial Sequence
  SARS-CoV-2/Wuhan/WIV05/2019__EPI_ISL_402128 spike protein mRNA gc mod (1-1273)(K986P_V987P_T478K_D614G_P681H_T732A)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccauggccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27382 - RNA, 4039 nt, Artificial Sequence
  SARS-CoV-2/Wuhan/WIV05/2019__EPI_ISL_402128 spike protein mRNA gc mod (1-1273)(K986P_V987P_E484K_N501Y_D614G_P681H_E1092K_H1101Y_V1176F )
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagaaagggcguguucguguccaacggcaccuacugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27383 - RNA, 4033 nt, Artificial Sequence
  SARS-CoV-2/Wuhan/WIV05/2019__EPI_ISL_402128 spike protein mRNA gc mod (1-1273)(K986P_V987P_H66D_G142V_Y144del_Y145del_D215G_V483A_D614G _H655Y_G669S_Q949R_N1187D)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguucgacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccuggugguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgccgaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuagcaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcgcgacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcuggacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27384 - RNA, 4036 nt, Artificial Sequence
  SARS-CoV-2/Wuhan/WIV05/2019__EPI_ISL_402128 spike protein mRNA gc mod (1-1273)(K986P_V987P_Y144del_L452R_T478K_P681R)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27385 - RNA, 4033 nt, Artificial Sequence
  SARS-CoV-2/Wuhan/WIV05/2019__EPI_ISL_402128 spike protein mRNA gc mod (1-1273)(K986P_V987P_T19R_Y144del_Y145del_L452R_T478K_D614G_P681R )
aggagaaagcuuaccauguucguguuccuggugcugcugccucugguguccagccagugugugaaccugcgcaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27386 - RNA, 4085 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H) R10410
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27387 - RNA, 4085 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V) R10510
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacagguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27388 - RNA, 4085 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L) R10520
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccgcgaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27389 - RNA, 4085 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L) R10577
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27390 - RNA, 4094 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F) R10616
aggagagucccgcagucggcguccagcggcucugcuuguucgugugugugucguugcaggccuuauucaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27391 - RNA, 4094 nt, Artificial Sequence
  SARS-CoV-2/Wuhan/WIV05/2019__EPI_ISL_402128 spike protein mRNA gc (1-1273)(K986P_V987P_E484K_D614G_V1176F) P5335
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27392 - RNA, 4094 nt, Artificial Sequence
  SARS-CoV-2/Wuhan/WIV05/2019__EPI_ISL_402128 spike protein mRNA gc (1-1273)(K986P_V987P_L452R_D614G_P681R) R10598
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27393 - RNA, 4094 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H) P5333
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27394 - RNA, 4088 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N) R10630
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27395 - RNA, 4073 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N) P5336, R10800
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcacgacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccaguaccgccuguuccgcaagagcaaccucaagcccuucgagcgggacaucuccaccgagaucuaccaggccggcagcacccccugcaacgggguggagggcuucaacugcuacagcccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27396 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_N439K_D614G) R10575
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27397 - RNA, 4094 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V) R10579
aggagagucccgcagucggcguccagcggcucugcuuguucgugugugugucguugcaggccuuauucaagcuuaccauguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27398 - RNA, 4094 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R) R10581
aggagagucccgcagucggcguccagcggcucugcuuguucgugugugugucguugcaggccuuauucaagcuuaccauguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccgcgcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27399 - RNA, 4094 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R) R10592
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccacgacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27400 - RNA, 4094 nt, Artificial Sequence
  SARS-CoV-2/Wuhan/WIV05/2019__EPI_ISL_402128 spike protein mRNA gc (1-1273)(K986P_V987P_S254F_D614G_P681R_G769V) R10615
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacuucagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggugaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27401 - RNA, 4076 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H) P5418
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacgccgucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccucuaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27402 - RNA, 4097 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N) R10679
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugaccagcaaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccaaguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27403 - RNA, 4103 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I) P5420
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggaccgaccgcgaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggcaagaccgggaagaucgccgacuacaacuacaagcugccggacgacuucacgggcugcgugaucgcguggaacagcaacaaccucgacuccaaggucgggggcaacuacaaguaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27404 - RNA, 4094 nt, Artificial Sequence
  SARS-CoV-2/Wuhan/WIV05/2019__EPI_ISL_402128 spike protein mRNA gc (1-1273)(K986P_V987P_T478K_D614G_P681H_T732A) P5416
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcauggccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27405 - RNA, 4094 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcaagggcguguucguguccaacgggaccuacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27406 - RNA, 4088 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguucgacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucguggugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccagcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcgcgacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccuggacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27407 - RNA, 4091 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27408 - RNA, 4088 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27409 - RNA, 4085 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27410 - RNA, 4085 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcaccgguccuaccucacgccgggcgacagcagcuccggcuggaccgcgggggccgccgccuacuacgugggcuaccugcagccccgcaccuuccugcucaaguacaacgagaacgggaccaucacggacgcggucgacugcgcccuggacccccugagcgagaccaagugcacccucaaguccuucaccguggagaagggcaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggggucagccccaccaagcucaacgaccugugcuucaccaacguguacgccgacuccuucgugauccgcggcgacgagguccggcagaucgcccccgggcagaccggcaacaucgccgacuacaacuacaagcugccggacgacuucacggggugcgugaucgcguggaacagcaacaaccucgacuccaaggugggcggcaacuacaacuaccuguaccgccuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccggguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgcgacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggcgccgggaucugcgccagcuaccagacgcagaccaacuccccgcggcgcgcccggagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgcgcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgguccuucaucgaggaccuccuguucaacaaggugacccuggccgacgccggguucaucaagcaguacggcgacugccucggggacaucgccgcgcgcgaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgguucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccuggggcagagcaagcggguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgcgagggcguguucguguccaacggcacccacugguucgucacgcagcggaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27411 - RNA, 4085 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccgggaccucuuccugcccuucuucagcaacgucacgugguuccacgugaucuccgggaccaacggcaccaagcgcuucgacaacccggugcugcccuucaacgacggggucuacuucgccagcaccgagaaguccaacaucauccggggcuggaucuucgggacgacccucgacagcaagacccagucccugcugaucgugaacaacgcgaccaacguggucaucaaggugugcgaguuccaguucugcaacgaccccuuccucggcguguaccacaagaacaacaagagcuggauggaguccgaguuccgcgucuacagcuccgccaacaacugcacguucgaguacgugagccagcccuuccugauggaccuggagggcaagcaggggaacuucaagaaccuccgggaguucguguucaagaacaucgacggcuacuucaagaucuacuccaagcacaccccgaucaaccugguccgcgaccugccccagggguucagcgcccucgagccccugguggaccugcccaucggcaucaacaucacccgguuccagacccuccuggcccugcaccgcuccuaccucacgccgggggacagcagcuccggcuggaccgccggcgcggccgccuacuacgugggguaccugcagccccggaccuuccugcucaaguacaacgagaacggcaccaucacggacgccgucgacugcgcgcuggacccccugagcgagaccaagugcacccucaaguccuucaccguggagaaggggaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccggcuguuccgcaagagcaaccucaagcccuucgagcgggacaucuccaccgagaucuaccaggcgggcagcacccccugcaacggggugaagggcuucaacugcuacuucccccugcaguccuacggguuccagccgaccaacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgggacccccagacccuggagauccucgacaucacccccugcagcuucggcgggguguccgugaucacgccgggcaccaacaccagcaaccaggucgcggugcuguaccagggcgugaacugcaccgagguccccguggccauccacgccgaccagcugacgcccaccuggcgcguguacuccaccgggagcaacgucuuccagacccgggccggcugccucaucggggccgagcacgugaacaacuccuacgagugcgacauccccaucggcgcgggcaucugcgccagcuaccagacgcacaccaacuccccgcgccgggcccgcagcguggccucccagagcaucaucgcguacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcccugacgggcaucgcgguggagcaggacaagaacacccaggagguguucgcccaggucaagcagaucuacaagacgcccccgaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccucggcgacaucgccgcgcgggaccugaucugcgcccagaaguucaacgggcugaccgugcucccgccccugcugaccgacgagaugaucgcccaguacaccagcgcccuccuggccggcaccaucacguccggguggacccugggcgcgggcgccgcccuccagauccccuucgccaugcagauggcguaccgcuucaacgggaucggcgucacccagaacgugcuguacgagaaccagaagcugaucgccaaccaguucaacagcgccaucgggaagauccaggacucccucagcuccaccgccagcgcccugggcaagcugcaggacguggucaaccagaacgcgcaggcccucaacacgcuggugaagcagcuguccagcaacuucggggccaucuccagcgugcucaacgacauccugucccggcuggacccgcccgaggccgagguccagaucgaccgccucaucaccggccggcugcagagccugcagaccuacgugacccagcagcucauccgcgccgcggagauccgggccagcgccaaccuggccgccaccaagauguccgagugcgugcugggccagagcaagcgcgucgacuucugcgggaagggcuaccaccucauguccuucccccagagcgcgccccacggggugguguuccugcacgucacguacgugcccgcccaggagaagaacuucaccaccgccccggccaucugccacgacggcaaggcgcacuucccccgggagggggucuucguguccaacggcacccacugguucgugacgcagcgcaacuucuacgagccccagaucaucaccaccgacaacaccuucgucagcggcaacugcgacguggugaucgggaucgucaacaacacgguguacgacccccugcagccggagcucgacuccuucaaggaggagcuggacaaguacuucaagaaccacaccagccccgacguggaccugggcgacaucuccgggaucaacgccagcgucgugaacauccagaaggagaucgaccggcucaacgagguggccaagaaccugaacgagucccugaucgaccuccaggagcugggcaaguacgagcaguacaucaaguggcccugguacaucuggcugggcuucaucgccgggcucaucgccaucgucauggugaccaucaugcugugcugcaugaccagcugcugcuccugccugaagggcugcugcagcugcggguccugcugcaaguucgacgaggacgacagcgagccggugcucaagggcgucaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27412 - RNA, 4085 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgccagcaccgagaaguccaacaucauccgcggcuggaucuucgggacgacccucgacagcaagacccagucccugcugaucgugaacaacgcgaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcgggguguccgugaucacgccgggcaccaacaccagcaaccaggucgcggugcuguaccagggcgugaacugcaccgagguccccguggccauccacgccgaccagcugacgcccaccuggcggguguacuccaccgggagcaacgucuuccagacccgcgccggcugccucaucggggccgagcacgugaacaacuccuacgagugcgacauccccaucggcgcgggcaucugcgccagcuaccagacgcacaccaacuccccgcggcgcgcccggagcguggccucccagagcaucaucgcguacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcccugacgggcaucgcgguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccgugcucccgccccugcugaccgacgagaugaucgcccaguacaccagcgcccuccuggccggcaccaucacguccggguggacccugggcgcgggcgccgcccuccagauccccuucgccaugcagauggcguaccgguucaacgggaucggcgucacccagaacgugcuguacgagaaccagaagcugaucgccaaccaguucaacagcgccaucgggaagauccaggacucccucagcuccaccgccagcgcccugggcaagcugcaggacguggucaaccagaacgcgcaggcccucaacacgcuggugaagcagcuguccagcaacuucggggccaucuccagcgugcucaacgacauccugucccgccuggacccgcccgaggccgagguccagaucgaccggcucaucaccggccgccugcagagccugcagaccuacgugacccagcagcucauccgggccgcggagauccgcgccagcgccaaccuggccgccaccaagauguccgagugcgugcugggccagagcaagcgggucgacuucugcgggaagggcuaccaccucauguccuucccccagagcgcgccccacggggugguguuccugcacgucacguacgugcccgcccaggagaagaacuucaccaccgccccggccaucugccacgacggcaaggcgcacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcucgacuccuucaaggaggagcuggacaaguacuucaagaaccacaccagccccgacguggaccugggcgacaucuccgggaucaacgccagcgucgugaacauccagaaggagaucgaccgccucaacgagguggccaagaaccugaacgagucccugaucgaccuccaggagcugggcaaguacgagcaguacaucaaguggcccugguacaucuggcugggcuucaucgccgggcucaucgccaucgucauggugaccaucaugcugugcugcaugaccagcugcugcuccugccugaagggcugcugcagcugcggguccugcugcaaguucgacgaggacgacagcgagccggugcucaagggcgucaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27413 - RNA, 4094 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcuucgucaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgugauggucaccaucaugcugugcugcaugaccagcugcugcuccugccucaagggcugcugcagcugcggguccugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27414 - RNA, 4094 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcuucgucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27415 - RNA, 4094 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcacccccugcaacgggguggagggcuucaacugcuacuucccccuccaguccuacggguuccagccgaccaacggcgugggguaccagcccuaccgcguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcgcguguacuccaccgggagcaacgucuuccagacccgggccggcugccugaucggggcggagcacgugaacaacuccuacgagugcgacauccccaucggcgccggcaucugcgccagcuaccagacgcagaccaacucccgccggcgcgcccggagcguggcgucccagagcaucaucgccuacaccaugucccucggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacccgcccgaggccgagguccagaucgaccggcugaucaccggccgccugcagagccuccagaccuacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucacguacgugcccgcccaggagaagaacuucaccaccgcccccgccaucugccacgacggcaaggcccacuucccgcgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27416 - RNA, 4094 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcacccccugcaacggggugcagggcuucaacugcuacuucccccuccaguccuacggguuccagccgaccaacggcgugggguaccagcccuaccgcguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcgcguguacuccaccgggagcaacgucuuccagacccgggccggcugccugaucggggcggagcacgugaacaacuccuacgagugcgacauccccaucggcgccggcaucugcgccagcuaccagacgcagaccaacucccgccggcgcgcccggagcguggcgucccagagcaucaucgccuacaccaugucccucggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacccgcccgaggccgagguccagaucgaccggcugaucaccggccgccugcagagccuccagaccuacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucacguacgugcccgcccacgagaagaacuucaccaccgcccccgccaucugccacgacggcaaggcccacuucccgcgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27417 - RNA, 4088 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagagucccgcagucggcguccagcggcucugcuuguucgugugugugucguugcaggccuuauucaagcuuaccauguucguguuccugguccuccugccccuggugagcucccagugcgugaaccuccgcacccggacccagcugccgcccgccuacacgaacagcuucacccgcggcgucuacuaccccgacaagguguuccgguccagcgugcugcacuccacccaggaccucuuccugcccuucuucagcaacgucaccugguuccacgccauccacguguccgggacgaacggcaccaagcgcuucgacaacccggugcugcccuucaacgacggggucuacuucgcgagcaccgagaaguccaacaucauccggggcuggaucuucgggaccacgcucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcaccuucgaguacgugagccagcccuuccugauggaccuggagggcaagcaggggaacuucaagaaccuccgcgaguucguguucaagaacaucgacggcuacuucaagaucuacuccaagcacacgccgaucaaccugguccgggaccugccccagggguucagcgcccucgagccccugguggaccugcccaucggcaucaacaucacccgcuuccagacccuccuggcccugcaccgguccuaccucaccccgggggacagcagcuccggcuggacggcgggcgccgccgccuacuacgugggguaccugcagccccgcaccuuccugcucaaguacaacgagaacggcaccaucaccgacgcggucgacugcgcccuggacccccugagcgagacgaagugcacccucaaguccuucaccguggagaaggggaucuaccagaccagcaacuuccgggugcagcccacggaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccaccuucaagugcuacggcgucagccccacgaagcucaacgaccugugcuucaccaacguguacgccgacuccuucgugauccgcggggacgagguccggcagaucgcccccggccagaccgggaagaucgccgacuacaacuacaagcugccggacgacuucaccggcugcgugaucgcguggaacagcaacaaccucgacuccaaggucgggggcaacuacaacuaccgcuaccggcuguuccgcaagagcaaccugaagcccuucgagcgggacaucuccacggagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccaccaaccuggucaagaacaagugcgugaacuucaacuucaacggccugacggggaccggcgugcucaccgagagcaacaagaaguuccugccguuccagcaguucgggcgcgacaucgccgacaccaccgacgcgguccgggacccccagacgcuggagauccuggacaucacccccugcagcuucggcgggguguccgugaucaccccgggcaccaacacgagcaaccaggucgccgugcucuaccagggcgugaacugcaccgagguccccguggccauccacgccgaccagcugacccccaccuggcgcguguacuccacggggagcaacgucuuccagacccgggccggcugccugaucggggcggagcacgugaacaacuccuacgagugcgacauccccaucggcgccggcaucugcgccagcuaccagacccagaccaacucccgccggcgcgcccggagcguggcgucccagagcaucaucgccuacacgaugucccucggggccgagaacagcgucgccuacuccaacaacagcaucgccaucccgaccaacuucaccaucuccgugaccacggagauccugcccgugagcaugaccaagaccagcgucgacugcaccauguacaucugcggcgacuccacggagugcagcaaccugcuccugcaguacggguccuucugcacccagcugaaccgcgcgcucaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugaccgugcugcccccgcuccugaccgacgagaugaucgcccaguacacgagcgcccugcucgcgggcaccaucaccuccggguggaccuucggcgccggcgccgcccugcagauccccuucgcgaugcagauggccuaccgguucaacgggaucggcgucacgcagaacgugcuguacgagaaccagaagcucaucgccaaccaguucaacagcgccaucgggaagauccaggacucccugagcuccaccgccagcgcgcugggcaagcuccagaacguggucaaccagaacgcccaggcccugaacacccuggugaagcagcucuccagcaacuucggggccaucuccagcgugcugaacgacauccugucccgccucgacccgcccgaggccgagguccagaucgaccggcugaucaccggccgccugcagagccuccagacguacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucaccuacgugcccgcccaggagaagaacuucaccacggcccccgccaucugccacgacggcaaggcccacuucccgcgcgagggggucuucguguccaacggcacccacugguucgugacccagcggaacuucuacgagccccagaucaucaccacggacaacaccuucgucagcggcaacugcgacguggugaucgggaucgucaacaacaccguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugacgaucaugcugugcugcaugaccagcugcugcuccugccucaagggcugcugcagcugcggguccugcugcaaguucgacgaggacgacagcgagcccgugcugaagggcgucaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27418 - RNA, 4073 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccgguccugcccuucaacgacggcguguacuucgcgagcaccgagaaguccaacaucauccgcggguggaucuucggcaccacgcucgacagcaagacccagucccugcugaucgugaacaacgccaccaacgucgugaucaaggugugcgaguuccaguucugcaacgaccccuuccucggggucuacuaccacaagaacaacaagagcuggauggaguccgaguuccggguguacagcuccgccaacaacugcaccuucgaguacgugagccagcccuuccugauggaccuggagggcaagcagggcaacuucaagaaccuccgcgaguucgucuucaagaacaucgacggguacuucaagaucuacuccaagcacacgccgaucaaccuggugcgggaccugccccagggcuucagcgcccucgagccccugguggaccugcccaucgggaucaacaucacccgcuuccagacccuccuggcccugcacgacuccagcagcggcuggaccgcgggggccgccgccuacuacgucggcuaccuccagccgcggacguuccugcugaaguacaacgagaacggcaccaucaccgacgcgguggacugcgcccucgacccccuguccgagaccaagugcacgcucaagagcuucaccguggagaaggggaucuaccagaccuccaacuuccgcguccagcccaccgagagcaucgugcgguuccccaacaucacgaaccucugcccguucggcgaggucuucaacgccacccgcuucgccuccguguacgccuggaaccggaagcgcaucagcaacugcguggcggacuacuccguccuguacaacagcgccuccuucagcaccuucaagugcuacggggugucccccaccaagcugaacgaccucugcuucacgaacguguacgccgacagcuucgucauccggggcgacgaggugcgccagaucgcccccggccagaccgggaagaucgccgacuacaacuacaagcugcccgacgacuucaccggcugcgugaucgcguggaacuccaacaaccuggacagcaaggucgggggcaacuacaacuaccaguaccggcuguuccgcaaguccaaccugaagccguucgagcgggacaucagcaccgagaucuaccaggccggguccacgcccugcaacggcguggagggcuucaacugcuacagcccccugcaguccuacggguuccagcccaccaacggcgugggguaccagccguaccgcgucguggugcucagcuucgagcugcugcacgcccccgccaccgucugcggccccaagaaguccaccaaccucgugaagaacaagugcgugaacuucaacuucaacgggcugacgggcaccggcguccugaccgaguccaacaagaaguuccuccccuuccagcaguucgggcgggacaucgccgacaccaccgacgcggugcgcgacccgcagacgcuggagauccuggacaucacccccugcagcuucggcgggguguccgucaucacccccggcaccaacacgagcaaccagguggccgugcuguaccagggggucaacugcaccgaggugccgguggccauccacgccgaccagcucacccccaccuggcgcgucuacuccacgggcagcaacguguuccagacccgggccggcugccugaucggggcggagcacgugaacaacuccuacgagugcgacauccccaucggcgccgggaucugcgccagcuaccagacccagaccaacagcccccgccgggcccgcagcgucgcgucccagagcaucaucgccuacacgaugucccugggcgccgagaacagcguggccuacuccaacaacagcaucgccaucccgaccaacuucaccaucuccgugaccacggagauccuccccgucagcaugaccaagaccagcguggacugcaccauguacaucugcggcgacuccacggagugcagcaaccugcugcuccaguacggguccuucugcacccagcugaaccgggcgcugaccggcaucgccguggagcaggacaagaacacccaggaggucuucgcccaggugaagcagaucuacaagacgccgcccaucaaggacuucgggggcuucaacuucagccagauccuccccgaccccuccaagcccagcaagcgcuccuucaucgaggaccugcuguucaacaaggugacccucgccgacgccggguucaucaagcaguacggcgacugccugggcgacaucgcggcccgggaccugaucugcgcccagaaguucaacgggcucaacguccugcccccgcugcucaccgacgagaugaucgcccaguacaccagcgcccugcuggcgggcacgaucaccuccggguggaccuucggcgccggggccgcccuccagauccccuucgcgaugcagauggccuaccgcuucaacggcaucggcgugacccagaacgugcuguacgagaaccagaagcugaucgccaaccaguucaacagcgccaucgggaagauccaggacucccucagcuccacggccagcgcgcugggcaagcugcaggacgucgugaaccagaacgcccaggcccucaacacccuggugaagcagcuguccagcaacuucggggccaucuccagcguccucaacgacauccugucccggcuggacccgcccgaggccgaggugcagaucgaccgccucaucaccggccggcugcagagccugcagaccuacgugacgcagcagcucauccgcgcggccgagauccgggccagcgccaaccuggccgcgaccaagauguccgagugcguccuggggcagagcaagcgcguggacuucugcggcaagggcuaccaccucauguccuucccccagagcgcgccccacgggguggucuuccugcacgugaccuacguccccgcccaggagaagaacuucaccaccgcccccgccaucugccacgacggcaaggcccacuucccgcgggaggggguguucguguccaacggcacgcacugguucgucacccagcgcaacuucuacgagccccagaucaucaccaccgacaacacguucgugagcgggaacugcgacguggucaucggcaucgugaacaacaccguguacgacccccugcagcccgagcucgacuccuucaaggaggagcuggacaaguacuucaagaaccacaccagcccggacgucgaccugggcgacaucuccgggaucaacgccagcguggugaacauccagaaggagaucgaccggcucaacgaggucgccaagaaccugaacgagucccugaucgaccuccaggagcugggcaaguacgagcaguacaucaaguggcccugguacaucuggcugggguucaucgccggccucaucgcgaucgugauggugaccaucaugcugugcugcaugacgagcugcugcuccugccugaagggcugcugcagcugcggguccugcugcaaguucgacgaggacgacagcgagcccguccucaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27419 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27420 - RNA, 4094 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccucauggaccuggagggcaagcaggggaacuucaagaaccugcgcgaguucguguucaagaacaucgacggcuacuucaagaucuacuccaagcacacgccgaucaaccucguccgggaccugccccagggguucagcgcccuggagccccucguggaccugcccaucggcaucaacaucacccgcuuccagacccugcucgcccugcaccgguccuaccugacccccgggggcagcagcuccggcuggacggcgggggccgccgccuacuacgugggcuaccuccagccccgcaccuuccugcugaaguacaacgagaacgggaccaucaccgacgcggucgacugcgcccucgacccccugagcgagacgaagugcacccugaaguccuucaccguggagaagggcaucuaccagaccagcaacuuccgggugcagcccacggaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccaccuucaagugcuacggggucagccccacgaagcugaacgaccucugcuucaccaacguguacgccgacuccuucgugauccgcggcgacgagguccggcagaucgcccccgggcagaccggcaagaucgccgacuacaacuacaagcugccggacgacuucaccgggugcgugaucgcguggaacagcaacaaccuggacuccaaggugggcggcaacuacaacuaccucuaccgccuguuccgcaagagcaaccugaagcccuucgagcgggacaucuccacggagaucuaccaggccgggagcacccccugcaacggcgucaagggguucaacugcuacuucccccuccaguccuacggcuuccagccgaccaacggggugggcuaccagcccuaccggguggucgugcugagcuucgagcugcuccacgcccccgccaccgugugcggccccaagaaguccacgaaccuggucaagaacaagugcgugaacuucaacuucaacgggcugaccggcaccggggugcucaccgagagcaacaagaaguuccugccguuccagcaguucggccgcgacaucgccgacaccacggacgcgguccgcgacccccagacccuggagauccuggacaucacccccugcagcuucgggggcguguccgugaucaccccgggcacgaacaccagcaaccaggucgccgugcucuaccagggggugaacugcaccgagguccccguggccauccacgccgaccagcugacccccacguggcggguguacuccaccggcagcaacgucuuccagacccgcgccgggugccugaucggcgcggagcacgugaacaacuccuacgagugcgacauccccaucggcgccgggaucugcgccagcuaccagacccagacgaacuccccgcggcgcgcccggagcguggcgucccagagcaucaucgccuacaccaugucccucggcgucgagaacagcguggccuacuccaacaacagcaucgccauccccaccaacuucaccaucuccgugacgaccgagauccugcccgucagcaugaccaagaccagcguggacugcacgauguacaucugcggggacuccaccgagugcagcaaccugcuccugcaguacggcuccuucugcacccagcugaaccgcgcccucaccgggaucgcgguggagcaggacaagaacacgcaggaggucuucgcccaggugaagcagaucuacaagacgcccccgaucaaggacuucggcggcuucaacuucagccagauccugcccgaccccuccaagcccagcaagcgguccuucaucgaggaccuccuguucaacaaggugacccuggccgacgccggguucaucaagcaguacggcgacugccugggggacaucgccgcgcgcgaccucaucugcgcccagaaguucaacggccugaccguccugccgccccuccugaccgacgagaugaucgcccaguacaccagcgcccugcucgccgggaccaucaccuccggcuggacguucggcgcgggggccgcccugcagauccccuucgccaugcagauggcguaccgguucaacggcaucggggugacccagaacgugcuguacgagaaccagaagcucaucgccaaccaguucaacagcgccaucggcaagauccaggacucccugagcuccaccgccagcgcccuggggaagcuccaggacgucgugaaccagaacgcgcaggcccugaacacccuggugaagcagcucuccagcaacuucggcgccaucuccagcguccugaacgacauccugucccgccucgacccgccggaggccgaggugcagaucgaccggcugaucacgggccgccugcagagccuccagaccuacgugacccagcagcugauccgggccgcggagauccgcgccagcgccaaccuggccgccaccaagauguccgagugcguccucgggcagagcaagcggguggacuucugcggcaagggguaccaccugauguccuucccccagagcgcgccccacggcguggucuuccugcacgugaccuacguccccgcccaggagaagaacuucacgaccgccccggccaucugccacgacgggaaggcgcacuucccccgcgagggcguguucguguccaacggcacccacugguucgucacccagcggaacuucuacgagccccagaucaucacgaccgacaacaccuucgugagcgggaacugcgacguggucaucggcaucgugaacaacaccguguacgacccccuccagccggagcuggacuccuucaaggaggagcuggacaaguacuucaagaaccacacgagccccgacgucgaccucggggacaucuccggcaucaacgccagcguggugaacauccagaaggagaucgaccgccugaacgaggucgccaagaaccugaacgagucccucaucgaccugcaggagcugggcaaguacgagcaguacaucaaguggcccugguacaucuggcucggguucaucgccggccugaucgccaucgugauggugaccaucaugcugugcugcaugaccagcugcugcuccugccucaaggggugcugcagcugcggcuccugcugcaaguucgacgaggacgacagcgagccgguccugaagggggugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27421 - RNA, 4094 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccucauggaccuggagggcaagcaggggaacuucaagaaccugcgcgaguucguguucaagaacaucgacggcuacuucaagaucuacuccaagcacacgccgaucaaccucguccgggaccugccccagggguucagcgcccuggagccccucguggaccugcccaucggcaucaacaucacccgcuuccagacccugcucgcccugcaccgguccuaccugacccccgggggcagcagcuccggcuggacggcgggggccgccgccuacuacgugggcuaccuccagccccgcaccuuccugcugaaguacaacgagaacgggaccaucaccgacgcggucgacugcgcccucgacccccugagcgagacgaagugcacccugaaguccuucaccguggagaagggcaucuaccagaccagcaacuuccgggugcagcccacggaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccaccuucaagugcuacggggucagccccacgaagcugaacgaccucugcuucaccaacguguacgccgacuccuucgugauccgcggcgacgagguccggcagaucgcccccgggcagaccggcaagaucgccgacuacaacuacaagcugccggacgacuucaccgggugcgugaucgcguggaacagcaacaaccuggacuccaaggugggcggcaacuacaacuaccucuaccgccuguuccgcaagagcaaccugaagcccuucgagcgggacaucuccacggagaucuaccaggccgggaacacccccugcaacggcgucgagggguucaacugcuacuucccccuccagagcuacggcuuccagccgaccaacggggugggcuaccagcccuaccggguggucgugcuguccuucgagcugcuccacgcccccgccaccgugugcggccccaagaaguccacgaaccuggucaagaacaagugcgugaacuucaacuucaacgggcugaccggcaccggggugcucaccgagagcaacaagaaguuccugccguuccagcaguucggccgcgacaucgccgacaccacggacgcgguccgcgacccccagacccuggagauccuggacaucacccccugcagcuucgggggcgugagcgugaucaccccgggcacgaacaccuccaaccaggucgccgugcucuaccagggggugaacugcaccgagguccccguggccauccacgccgaccagcugacccccacguggcggguguacagcaccggcuccaacgucuuccagacccgcgccgggugccugaucggcgcggagcacgugaacaacagcuacgagugcgacauccccaucggcgccgggaucugcgccuccuaccagacccagacgaacagcccgcggcgcgcccgguccguggcgagccaguccaucaucgccuacaccaugagccucggcgccgagaacuccgucgccuacagcaacaacuccaucgccauccccaccaacuucaccaucagcgugacgaccgagauccugcccguguccaugaccaagaccagcgucgacugcacgauguacaucugcggggacagcaccgagugcuccaaccugcuccugcaguacggcagcuucugcacccagcugaaccgcgcgcucaccgggaucgccguggagcaggacaagaacacgcaggagguguucgcccaggucaagcagaucuacaagacgcccccgaucaaggacuucggcggcuucaacuucucccagauccugcccgaccccagcaagcccuccaagcggagcuucaucgaggaccuccuguucaacaaggugacccuggccgacgccggguucaucaagcaguacggcgacugccugggggacaucgcggcccgcgaccucaucugcgcccagaaguucaacggccugaccgugcugccgccccuccugaccgacgagaugaucgcccaguacaccuccgcccugcucgcggggaccaucaccagcggcuggacguucggcgccggggccgcccugcagauccccuucgcgaugcagauggccuaccgguucaacggcaucggggucacccagaacgugcuguacgagaaccagaagcucaucgccaaccaguucaacuccgccaucggcaagauccaggacagccuguccagcaccgccuccgcgcuggggaagcuccaggacguggucaaccagaacgcccgcgcccugaacacccuggugaagcagcucagcuccaacuucggcgccaucagcuccgugcugaacgacauccugagccggcucgacccgccggaggccgagguccagaucgaccgccugaucacgggccggcugcagucccuccagaccuacgugacccagcagcugauccgcgcggccgagauccgggccagcgccaaccuggccgcgaccaagaugagcgagugcgugcucgggcaguccaagcgcgucgacuucugcggcaagggguaccaccugaugagcuucccccaguccgcgccccacggcgugguguuccugcacgucaccuacgugcccgcccaggagaagaacuucacgaccgccccggccaucugccacgacgggaaggcccacuucccccgggagggcgucuucgugagcaacggcacccacugguucgugacccagcgcaacuucuacgagccccagaucaucacgaccgacaacaccuucgucuccgggaacugcgacguggugaucggcaucgucaacaacaccguguacgacccccuccagccggagcuggacagcuucaaggaggagcuggacaaguacuucaagaaccacacgucccccgacguggaccucggggacaucagcggcaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggguucaucgccggccugaucgcgaucgucauggugaccaucaugcugugcugcaugaccuccugcugcagcugccucaaggggugcugcuccugcggcagcugcugcaaguucgacgaggacgacuccgagccggugcugaagggggucaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27422 - RNA, 4094 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccucgagggcaagcaggggaacuucaagaaccugcgcgaguucguguucaagaacaucgacggcuacuucaagaucuacuccaagcacaccccgaucaaccugguccgggaccucccccagggguucagcgcccuggagccccugguggaccuccccaucggcaucaacaucacccgcuuccagacccugcuggcccuccaccgguccuaccugacgccgggggacagcagcuccggcuggaccgcgggcgccgccgccuacuacgugggguaccugcagccccgcaccuuccuccugaaguacaacgagaacggcaccaucacggacgcggucgacugcgcccuggacccccucagcgagaccaagugcacccugaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccucuacaacuccgccagcuucuccacguucaagugcuacggcgugagccccaccaagcugaacgaccugugcuucaccaacgucuacgccgacuccuucgugauccgcggggacgaggugcggcagaucgcccccggccagaccgggaagaucgccgacuacaacuacaagcucccggacgacuucacgggcugcgucaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccucagcuucgagcugcugcacgcccccgccacggugugcggccccaagaaguccaccaaccucgugaagaacaagugcgucaacuucaacuucaacggccugaccgggaccggcgugcugaccgagagcaacaagaaguuccugccguuccagcaguucgggcgcgacaucgccgacacgaccgacgcggugcgcgacccccagacccucgagauccuggacaucacccccugcagcuucggcggggucuccgugaucacgccgggcaccaacaccagcaaccagguggccguccuguaccacgacgugaacugcaccgaggugcccgucgccauccacgccgaccagcucacgcccaccuggcggguguacuccaccggcagcaacguguuccagacccgcgccgggugccugaucggcgcggagcacgucaacaacuccuacgagugcgacauccccaucggggccggcaucugcgccagcuaccagacgcagaccaacucccggcgccgggcccgcagcguggcgucccagagcaucaucgccuacaccaugucccugggcgccgagaacagcguggccuacuccaacaacagcaucgccaucccgaccaacuucacgaucuccgucaccaccgagauccuccccgugagcaugaccaagacgagcguggacugcaccauguacaucugcggggacuccaccgagugcagcaaccugcugcuccaguacggcuccuucugcacccagcugaaccgggcgcugacggggaucgccgucgagcaggacaagaacacccaggagguguucgcccaggugaagcagaucuacaagaccccgcccaucaaggacuucggcggguucaacuucagccagauccuccccgaccccuccaagcccagcaagcgcuccuucaucgaggaccugcuguucaacaaggucacccucgccgacgccggcuucaucaagcaguacggcgacugccugggggacaucgcggcccgggaccugaucugcgcccagaaguucaacggccucacggugcugcccccgcugcucaccgacgagaugaucgcccaguacaccagcgcccugcuggcggggaccaucacguccggcuggaccuucggggccggcgccgcccuccagauccccuucgcgaugcagauggccuaccgcuucaacggcaucggggugacccagaacguccuguacgagaaccagaagcugaucgccaaccaguucaacagcgccaucggcaagauccaggacucccucagcuccaccgccagcgcgcuggggaagcugcaggacguggugaaccagaacgcccaggcccucaacacgcuggucaagcagcuguccagcaacuucggcgccaucuccagcgugcucaacgacauccugucccggcuggacccgcccgaggccgaggugcagaucgaccgccucaucaccgggcggcugcagagccugcagaccuacgucacccagcagcucauccgcgcggccgagauccgggccagcgccaaccuggccgcgaccaagauguccgagugcgugcugggccagagcaagcgcguggacuucugcggcaagggguaccaccucauguccuucccccagagcgcgccccacggcgucguguuccugcacgugacguacguccccgcccaggagaagaacuucaccaccgcccccgccaucugccacgacgggaaggcccacuucccgcgggagggcguguucgucuccaacgggacccacugguucgugacgcagcgcaacuucuacgagccccagaucaucaccaccgacaacaccuucgugagcggcaacugcgacgucgugaucggcaucgugaacaacacggucuacgacccccugcagcccgagcucgacuccuucaaggaggagcuggacaaguacuucaagaaccacaccagcccggacguggaccugggggacaucuccggcaucaacgccagcguggucaacauccagaaggagaucgaccggcucaacgagguggccaagaaccugaacgagucccugaucgaccuccaggagcuggggaaguacgagcaguacaucaaguggcccugguacaucuggcugggcuucaucgccggccucaucgcgaucgugauggucaccaucaugcugugcugcaugaccagcugcugcuccugccugaaggggugcugcagcugcggcuccugcugcaaguucgacgaggacgacagcgagcccgugcucaagggggugaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27423 - RNA, 4094 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacuucagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccgccuguuccggaaguccaaccucaagcccuucgagcgcgacaucagcaccgagaucuaccaggccggcuccacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagccggcgccgggcccgcuccguggcgagccaguccaucaucgccuacaccaugagccugggggccgagaacuccgucgccuacagcaacaacuccaucgccaucccgaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgggcgcugacggugaucgccguggagcaggacaagaacacccaggaggucuucgcccaggugaagcagaucuacaagaccccgcccaucaaggacuucggcggguucaacuucucccagauccugcccgaccccagcaagcccuccaagcgcagcuucaucgaggaccuccuguucaacaaggugacccuggccgacgccggcuucaucaagcaguacggcgacugccucggggacaucgcggcccgggaccugaucugcgcccagaaguucaacggccugacgguccugcccccgcuccugaccgacgagaugaucgcccaguacaccuccgcccuccuggcggggaccaucacgagcggcuggaccuucggggccggcgccgcccugcagauccccuucgcgaugcagauggccuaccgcuucaacggcaucggggugacccagaacgugcucuacgagaaccagaagcugaucgccaaccaguucaacuccgccaucggcaagauccaggacagccuguccagcaccgccuccgcgcucgggaagcugcaggacgucgugaaccagaacgcccaggcccugaacacgcucgugaagcagcugagcuccaacuucggcgccaucagcuccguccugaacgacauccucagccggcuggacccgcccgaggccgaggugcagaucgaccgccugaucaccgggcggcuccagucccugcagaccuacgugacccagcagcugauccgcgcggccgagauccgggccagcgccaaccucgccgcgaccaagaugagcgagugcguccugggccaguccaagcgcguggacuucugcggcaagggguaccaccugaugagcuucccccaguccgcgccccacggcguggucuuccuccacgugacguacguccccgcccaggagaagaacuucaccaccgcccccgccaucugccacgacgggaaggcccacuucccgcgggagggcguguucgugagcaacgggacccacugguucgucacgcagcgcaacuucuacgagccccagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccuccccggacgucgaccugggggacaucagcggcaucaacgccuccguggugaacauccagaaggagaucgaccggcugaacgaggucgccaagaaccucaacgagagccugaucgaccugcaggagcucgggaaguacgagcaguacaucaaguggcccugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27424 - RNA, 4076 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgagcgccuacaccaacuccuucacccggggcgucuacuaccccgacaagguguuccgcagcuccgugcugcacagcacccaggaccucuuccugcccuucuucuccaacgucacgugguuccacgccaucagcgggaccaacggcaccaagcgguucgacaaccccgugcugccguucaacgacgggguguacuucgcguccaccgagaaguccaacaucauccgcggcuggaucuucgggacgacccucgacagcaagacccagagccugcugaucgucaacaacgccaccaacgccgugaucaaggugugcgaguuccaguucugcaacgaccccuuccucggcgucuaccacaagaacaacaaguccuggauggagagcgaguuccggguguacuccagcgccaacaacugcacguucgaguacgugucccagcccuuccugauggaccuggagggcaagcaggggaacuucaagaaccuccgcgaguucgucuucaagaacaucgacggcuacuucaagaucuacagcaagcacacccccaucaaccuggugcgggaccugccgcagggguucuccgcccucgagccccugguggaccugcccaucggcaucaacaucacccgcuuccagacccucuaccggagcuaccugacgcccggggacagcuccagcggcuggaccgcgggcgccgccgccuacuacgucggguaccugcagccgcgcaccuuccuccugaaguacaacgagaacggcaccaucacggacgcgguggacugcgcccuggacccccucuccgagaccaagugcacccucaagagcuucaccguggagaaggggaucuaccagacguccaacuuccggguccagcccaccgagagcaucgugcgcuuccccaacaucaccaaccugugcccguucggcgagguguucaacgccacccgguucgccuccgucuacgccuggaaccgcaagcggaucagcaacugcguggcggacuacuccguccuguacaacagcgccuccuucagcacguucaagugcuacggcgugucccccaccaagcugaacgaccugugcuucaccaacguguacgccgacagcuucgucauccgcggggacgaggugcggcagaucgcccccggccagaccgggaagaucgccgacuacaacuacaagcuccccgacgacuucacgggcugcgugaucgcguggaacuccaacaaccuggacagcaaggucgggggcaacuacaacuaccuguaccgccucuuccggaaguccaaccugaagccguucgagcgcgacaucagcaccgagaucuaccaggccggcaacacccccugcaacggggugaagggcuucaacugcuacuucccccugcaguccuacggguuccagcccaccaacggcgugggguaccagccguaccgggucguggugcucagcuucgagcugcugcacgcccccgccacggucugcggccccaagaaguccaccaaccucgugaagaacaagugcgugaacuucaacuucaacggccugaccgggaccggcguccugaccgagagcaacaagaaguuccuccccuuccagcaguucgggcgcgacaucgccgacacgaccgacgcggugcgcgacccgcagacccuggagauccuggacaucacccccugcagcuucggcgggguguccgucaucacgcccggcaccaacaccagcaaccagguggccgugcuguaccagggcgucaacugcaccgaggugccgguggccauccacgccgaccagcucacgcccaccuggcgggucuacuccaccgggagcaacguguuccagacccgcgccggcugccugaucggggcggagcacgugaacaacuccuacgagugcgacauccccaucggcgccggcaucugcgccagcuaccagacgcagaccaacucccaccggcgcgcccggagcgucgcgucccagagcaucaucgccuacaccaugucccugggggccgagaacagcguggccuacuccaacaacagcaucgccauccccaccaacuucacgaucuccgugaccaccgagauccucccggucagcaugaccaagacgagcguggacugcaccauguacaucugcggcgacuccaccgagugcagcaaccugcugcuccaguacggguccuucugcacccagcugaaccgcgcgcugacgggcaucgccguggagcaggacaagaacacccaggaggucuucgcccaggugaagcagaucuacaagaccccgcccaucaaggacuucgggggcuucaacuucagccagauccuccccgaccccuccaagcccagcaagcgguccuucaucgaggaccugcuguucaacaaggugacccucgccgacgccggcuucaucaagcaguacggggacugccugggcgacaucgcggcccgcgaccugaucugcgcccagaaguucaacgggcucacgguccugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgugacccagaacgugcuguacgagaaccagaagcugaucgccaaccaguucaacagcgccaucgggaagauccaggacucccucagcuccaccgccagcgcgcugggcaagcugcaggacgucgugaaccagaacgcccaggcccucaacacgcuggugaagcagcuguccagcaacuucggggccaucuccagcguccucaacgacauccugucccgccuggacccgcccgaggccgaggugcagaucgaccggcucaucaccggccgccugcagagccugcagaccuacgugacccagcagcucauccgggcggccgagauccgcgccagcgccaaccuggccgcgaucaagauguccgagugcguccugggccagagcaagcggguggacuucugcgggaagggcuaccaccucauguccuucccccagagcgcgccccacgggguggucuuccugcacgugaccuacgugcccgcccaggagaagaacuucacgaccgcccccgccaucugccacgacggcaaggcccacuucccccgcgagggggucuucguguccaacggcacccacugguucgucacccagcggaacuucuacgagccgcagaucaucacgacccacaacaccuucgugagcggcaacugcgacguggucaucgggaucgugaacaacaccguguacgacccccugcagcccgagcucgacuccuucaaggaggagcuggacaaguacuucaagaaccacacgagccccgacgucgaccugggcgacaucuccgggaucaacgccagcguggugaacauccagaaggagaucgaccgccucaacgaggucgccaagaaccugaacgagucccugaucgaccuccaggagcugggcaaguacgagcaguacaucaaguggccgugguacaucuggcugggcuucaucgccgggcucaucgcgaucgugauggugaccaucaugcugugcugcaugaccagcugcugcuccugccugaagggcugcugcagcugcggguccugcugcaaguucgacgaggacgacagcgagcccguccucaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27425 - RNA, 4097 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcucgacagcaagacccagucccugcugaucgugaacaacgccaccaacguggucaucaaggugugcgaguuccaguucugcaacgaccccuuccucggcgugaccagcaaccacaagaacaacaaguccuggauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacagcuccagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccaccaaguucgccuccgucuacgccuggaaccggaagcgcaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccggcuguuccgcaaguccaaccucaagcccuucgagcgggacaucagcaccgagaucuaccaggccggcuccacccccugcaacggggugaagggcuucaacugcuacuucccccugcagagcuacggguuccagccgaccuacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgggacaucgccgacacgaccgacgcgguccgcgacccccagacccuggagauccucgacaucacccccugcuccuucggcggggugagcgugaucacgccgggcaccaacaccuccaaccaggucgccgugcuguaccagggcgugaacugcaccgagguccccguggccauccacgccgaccagcugacgcccaccuggcgcguguacagcaccggguccaacgucuuccagacccgggccggcugccucaucggggcggagcacgugaacaacagcuacgagugcgacauccccaucggcgccggcaucugcgccuccuaccagacgcagaccaacagccaccgccgggcccgcuccguggcgagccaguccaucaucgccuacaccaugagccugggggccgagaacuccgucgccuacagcaacaacuccaucgccaucccgaccaacuucacgaucagcgugaccaccgagauccugcccgugagcaugaccaagacguccgucgacugcaccauguacaucugcggcgacagcaccgagugcuccaaccuccugcugcaguacgggagcuucugcacccagcucaaccgggcgcugacgggcaucgccguggagcaggacaagaacacccaggagguguucgcccaggucaagcagaucuacaagaccccgcccaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccucggcgacaucgcggcccgggaccugaucugcgcccagaaguucaacgggcugacggugcugcccccgcuccugaccgacgagaugaucgcccaguacaccuccgcccuccuggcgggcaccaucacgagcggguggaccuucggcgccggcgccgcccugcagauccccuucgcgaugcagauggccuaccgcuucaacgggaucggcgucacccagaacgugcucuacgagaaccagaagcugaucgccaaccaguucaacuccgccaucgggaagauccaggacagccuguccagcaccgccuccgcgcucggcaagcugcagaacguggucaaccagaacgcccaggcccugaacacgcucgugaagcagcugagcuccaacuucggggccaucagcuccgugcugaacgacauccucagccggcuggacccgcccgaggccgagguccagaucgaccgccugaucaccggccggcuccagagccugcagaccuacgugacccagcagcugauccgcgcggccgagauccgggccuccgccaaccucgccgcgaccaagaugagcgagugcgugcugggccaguccaagcgcgucgacuucugcgggaagggcuaccaccugaugagcuucccccaguccgcgccccacggggugguguuccuccacgucacguacgugcccgcccaggagaagaacuucaccaccgcccccgccaucugccacgacggcaaggcccacuucccgcgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccugcagcccgagcuggacagcuucaaggaggagcucgacaaguacuucaagaaccacaccuccccggacguggaccugggcgacaucagcgggaucaacgccuccgucgugaacauccagaaggagaucgaccggcugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagcccgugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27426 - RNA, 4103 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggaccgaccgcgaccugccccagggguucagcgcccucgagccccugguggaccugcccaucggcaucaacaucacccgguuccagacgcuccuggcccugcaccgcuccuaccucaccccgggggacagcagcuccggcuggaccgcgggcgccgccgccuacuacgugggguaccugcagccccggaccuuccugcucaaguacaacgagaacggcacgaucaccgacgcggucgacugcgcccuggacccccugagcgagaccaagugcacccucaaguccuucacgguggagaaggggaucuaccagaccagcaacuuccgcgugcagcccaccgaguccaucguccgguucccgaacaucaccaaccugugccccuucggcgagguguucaacgccacgcgcuucgccagcgucuacgccuggaaccggaagcgcaucuccaacugcguggcggacuacagcgugcuguacaacuccgccagcuucuccaccuucaagugcuacggcgucagccccaccaagcucaacgaccugugcuucaccaacguguacgccgacuccuucgugauccgcggggacgagguccggcagaucgcccccggcaagacggggaagaucgccgacuacaacuacaagcugccggacgacuucaccggcugcgugaucgcguggaacagcaacaaccucgacuccaaggucgggggcaacuacaaguaccuguaccggcuguuccgcaagagcaaccucaagcccuucgagcgggacaucuccaccgagaucuaccaggccggcagcacccccugcaacgggguggagggcuucaacugcuacuucccccugcaguccuacggguuccagccgacgaacggcgugggguaccagcccuaccgcguggucgugcugagcuucgagcuccugcacgcccccgccaccgugugcggccccaagaaguccaccaaccuggucaagaacaagugcgugaacuucaacuucaacggccucaccgggaccggcgugcugacggagagcaacaagaaguuccugccguuccagcaguucgggcgcgacaucgccgacaccaccgacgcgguccgggacccccagacccuggagauccucgacaucacgcccugcagcuucggcgggguguccgugaucaccccgggcaccaacaccagcaaccaggucgccgugcuguaccagggcgugaacugcacggagguccccguggccauccacgccgaccagcugacccccaccuggcgcguguacuccaccgggagcaacgucuuccagacgcgggccggcugccucaucggggcggagcacgugaacaacuccuacgagugcgacauccccaucggcgccggcaucugcgccagcuaccagacccagaccaacuccccgcgccgggcccgcagcguggcgucccagagcaucaucgccuacaccaugucccugggggccgagaacagcgucgccuacuccaacaacagcaucgccauccccaucaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccucggcgacaucgcggcccgggaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgcuucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccggcuggacccgcccgaggccgagguccagaucgaccgccugaucaccggccggcuccagagccugcagaccuacgugacccagcagcugauccgcgcggccgagauccgggccagcgccaaccucgccgcgaccaagauguccgagugcgugcugggccagagcaagcgcgucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgggagggggucuucguguccaacggcacccacugguucgugacgcagcgcaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccggcugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27427 - RNA, 4094 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccaccgugugcggccccaagaaguccacgaaccuggucaagaacaagugcgugaacuucaacuucaacggccucaccgggaccggcgugcugaccgagagcaacaagaaguuccugccguuccagcaguucgggcgcgacaucgccgacaccacggacgcgguccgcgacccccagacccuggagauccucgacaucacccccugcagcuucggcgggguguccgugaucaccccgggcacgaacaccagcaaccaggucgccgugcuguaccagggcgugaacugcaccgagguccccguggccauccacgccgaccagcugacccccacguggcggguguacuccaccgggagcaacgucuuccagacccgcgccggcugccucaucggggcggagcacgugaacaacuccuacgagugcgacauccccaucggcgccggcaucugcgccagcuaccagacccagacgaacucccaccggcgcgcccggagcguggcgucccagagcaucaucgccuacaccaugucccugggggccgagaacagcgucgccuacuccaacaacagcaucgccaucccgaccaacuucaccaucuccgugacgaccgagauccugcccgugagcauggcgaagaccagcgucgacugcaccauguacaucugcggcgacuccacggagugcagcaaccuccugcugcaguacggguccuucugcacccagcucaaccgcgcccugaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgguccuucaucgaggaccuccuguucaacaaggugacccuggccgacgcgggcuucaucaagcaguacggggacugccucggcgacaucgccgcccgcgaccugaucugcgcccagaaguucaacgggcugaccgugcugcccccgcuccugaccgacgagaugaucgcccaguacacgagcgcgcuccuggccggcaccaucaccuccggguggaccuucggcgccggcgccgcgcugcagauccccuucgccaugcagauggccuaccgguucaacgggaucggcgucacgcagaacgugcucuacgagaaccagaagcugaucgccaaccaguucaacagcgccaucgggaagauccaggacucccugagcuccaccgcgagcgcccucggcaagcugcaggacguggucaaccagaacgcccaggcccugaacacccucgugaagcagcuguccagcaacuucggggccaucuccagcgugcugaacgacauccucucccgccuggacccgcccgaggcggagguccagaucgaccggcugaucaccggccgccuccagagccugcagacguacgugacccagcagcugauccgggccgccgagauccgcgccagcgccaaccucgcggccaccaagauguccgagugcgugcugggccagagcaagcgggucgacuucugcgggaagggcuaccaccugauguccuucccccagagcgcgccccacggggugguguuccuccacgucaccuacgugcccgcccaggagaagaacuucaccacggcccccgccaucugccacgacggcaaggcccacuucccgcgcgagggggucuucguguccaacggcacccacugguucgugacccagcggaacuucuacgagccccagaucaucaccacggacaacaccuucgucagcggcaacugcgacguggugaucgggaucgucaacaacaccguguacgacccccugcagcccgagcuggacuccuucaaggaggagcucgacaaguacuucaagaaccacaccagcccggacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgcggggcugaucgccaucgucauggugacgaucaugcucugcugcaugaccagcugcugcuccugccugaagggcugcugcagcugcggguccugcugcaaguucgacgaggacgacagcgagcccgugcugaagggcgucaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27428 - RNA, 4094 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacucccaccggcgcgcccggagcguggcgucccagagcaucaucgccuacaccaugucccugggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugacggugcugcccccgcuccugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgcccccgccaucugccacgacggcaaggcccacuucccgcgcaagggggucuucguguccaacggcaccuacugguucgugacgcagcggaacuucuacgagccccagaucaucaccaccgacaacaccuucgucagcggcaacugcgacguggugaucgggaucgucaacaacacgguguacgacccccugcagcccgagcuggacuccuucaaggaggagcucgacaaguacuucaagaaccacaccagcccggacguggaccugggcgacaucuccgggaucaacgccagcuucgucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27429 - RNA, 4088 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguucgacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgugguccacaagaacaacaagagcuggauggaguccgaguuccggguguacagcuccgccaacaacugcacguucgaguacgugagccagcccuuccugauggaccuggagggcaagcagggcaacuucaagaaccuccgcgaguucgucuucaagaacaucgacggguacuucaagaucuacuccaagcacaccccgaucaaccuggugcggggccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgucggguaccugcagccccgcaccuuccugcucaaguacaacgagaacggcaccaucacggacgcgguggacugcgcccuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggcggacuacagcguccuguacaacuccgccagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgcggacacgaccgacgccguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgcgggcugccucaucggggccgaguacgugaacaacuccuacgagugcgacauccccaucggcgccagcaucugcgccuccuaccagacgcagaccaacagcccgcggcgcgcgcgguccguggccagccaguccaucaucgccuacaccaugagccugggcgccgagaacuccgucgccuacagcaacaacuccaucgcgauccccaccaacuucacgaucagcgugaccaccgagauccugcccgugagcaugaccaagacguccgucgacugcaccauguacaucugcggggacagcaccgagugcuccaaccuccugcugcaguacggcagcuucugcacccagcucaaccgcgcccugacggggaucgccguggagcaggacaagaacacccaggagguguucgcccaggucaagcagaucuacaagacgcccccgaucaaggacuucggcggguucaacuucucccagauccugcccgaccccagcaagcccuccaagcggagcuucaucgaggaccuccuguucaacaaggugacccuggccgacgcgggcuucaucaagcaguacggcgacugccucggggacaucgccgcccgcgaccugaucugcgcccagaaguucaacggccugaccgugcucccgccccugcugaccgacgagaugaucgcccaguacaccuccgcgcuccuggccgggaccaucacgagcggcuggaccuucggggccggcgccgcgcugcagauccccuucgccaugcagauggccuaccgguucaacggcaucggggucacccagaacgugcucuacgagaaccagaagcugaucgccaaccaguucaacuccgccaucggcaagauccaggacagccuguccagcaccgcguccgcccucgggaagcugcgcgacguggucaaccagaacgcccaggcccugaacacgcucgugaagcagcugagcuccaacuucggcgccaucagcuccgugcugaacgacauccucagccggcuggacccgcccgaggcggagguccagaucgaccgccugaucaccgggcggcuccagagccugcagaccuacgugacccagcagcugauccgcgccgccgagauccgggccuccgccaaccucgcggccaccaagaugagcgagugcgugcugggccaguccaagcgcgucgacuucugcggcaagggguaccaccugaugagcuucccccaguccgcgccccacggcgugguguuccuccacgucacguacgugcccgcccaggagaagaacuucaccaccgccccggccaucugccacgacgggaaggcccacuucccccgggagggcgucuucgugagcaacgggacccacugguucgugacgcagcgcaacuucuacgagccccagaucaucaccaccgacaacaccuucgucuccggcaacugcgacguggugaucggcaucgucaacaacacgguguacgacccccugcagccggagcuggacagcuucaaggaggagcucgacaaguacuucaagaaccacaccucccccgacguggaccugggggacaucagcggcaucaacgccuccgucgugaacauccagaaggagaucgaccggcuggacgagguggccaagaaccucaacgagagccugaucgaccugcaggagcucgggaaguacgagcaguacaucaaguggcccugguacaucuggcugggcuucaucgcgggccugaucgccaucgucauggugaccaucaugcucugcugcaugaccuccugcugcagcugccugaaggggugcugcuccugcggcagcugcugcaaguucgacgaggacgacuccgagccggugcugaagggggucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27430 - RNA, 4091 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccacgaaccuggucaagaacaagugcgugaacuucaacuucaacggccugaccgggaccggcgugcucaccgagagcaacaagaaguuccugccguuccagcaguucgggcgcgacaucgccgacaccacggacgcgguccgggacccccagacccuggagauccuggacaucacccccugcagcuucggcgggguguccgugaucaccccgggcacgaacaccagcaaccaggucgccgugcucuaccaggacgugaacugcaccgagguccccguggccauccacgccgaccagcugacccccacguggcgcguguacuccaccggcagcaacgucuuccagacccgggccgggugccugaucggcgcggagcacgugaacaacuccuacgagugcgacauccccaucggggccggcaucugcgccagcuaccagacccagacgaacucccgccggcgcgcccggagcguggcgucccagagcaucaucgccuacaccaugucccucggcgccgagaacagcgucgccuacuccaacaacagcaucgccaucccgaccaacuucaccaucuccgugacgaccgagauccugcccgugagcaugaccaagaccagcgucgacugcacgauguacaucugcggggacuccaccgagugcagcaaccugcuccugcaguacggcuccuucugcacccagcugaaccgcgcgcucaccgggaucgccguggagcaggacaagaacacgcaggagguguucgcccaggucaagcagaucuacaagaccccgcccaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccugggggacaucgcggcccgcgaccucaucugcgcccagaaguucaacggccugaccgugcugcccccgcuccugacggacgagaugaucgcccaguacaccagcgcccugcucgcggggaccaucaccuccggcuggacguucggggccggcgccgcccugcagauccccuucgcgaugcagauggccuaccgguucaacggcaucggggucacccagaacgugcuguacgagaaccagaagcucaucgccaaccaguucaacagcgccaucggcaagauccaggacucccugagcuccaccgccagcgcgcuggggaagcuccaggacguggucaaccagaacgcccaggcccugaacacccuggugaagcagcucuccagcaacuucggcgccaucuccagcgugcugaacgacauccugucccgccucgacccgcccgaggccgagguccagaucgaccggcugaucacggggcgccugcagagccuccagaccuacgugacccagcagcugauccgggcggccgagauccgcgccagcgccaaccuggccgcgaccaagauguccgagugcgugcucggccagagcaagcgggucgacuucugcggcaagggguaccaccugauguccuucccccagagcgcgccccacggcgugguguuccugcacgucaccuacgugcccgcccaggagaagaacuucacgaccgcccccgccaucugccacgacgggaaggcccacuucccgcgcgagggcgucuucguguccaacgggacccacugguucgugacccagcggaacuucuacgagccccagaucaucacgaccgacaacaccuucgucagcggcaacugcgacguggugaucggcaucgucaacaacaccguguacgacccccuccagcccgagcuggacuccuucaaggaggagcuggacaaguacuucaagaaccacacgagcccggacguggaccucggggacaucuccggcaucaacgccagcgucgugaacauccagaaggagaucgaccgccugaacgagguggccaagaaccugaacgagucccucaucgaccugcaggagcuggggaaguacgagcaguacaucaaguggcccugguacaucuggcucggcuucaucgccggccugaucgcgaucgucauggugaccaucaugcugugcugcaugaccagcugcugcuccugccucaaggggugcugcagcugcggcuccugcugcaaguucgacgaggacgacagcgagcccgugcugaagggggucaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27431 - RNA, 4088 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuccugguccuccugccccuggugagcucccagugcgugaaccuccgcacccggacccagcugccgcccgccuacacgaacagcuucacccgcggcgucuacuaccccgacaagguguuccgguccagcgugcugcacuccacccaggaccucuuccugcccuucuucagcaacgucaccugguuccacgccauccacguguccgggacgaacggcaccaagcgcuucgacaacccggugcugcccuucaacgacggggucuacuucgcgagcaccgagaaguccaacaucauccggggcuggaucuucgggaccacgcucgacagcaagacccagucccugcugaucgugaacaacgccaccaacguggucaucaaggugugcgaguuccaguucugcaacgaccccuuccucggcgugcacaagaacaacaagagcuggauggaguccgaguuccgcgucuacagcuccgccaacaacugcaccuucgaguacgugagccagcccuuccugauggaccuggagggcaagcaggggaacuucaagaaccuccgggaguucguguucaagaacaucgacggcuacuucaagaucuacuccaagcacacgccgaucaaccugguccgcgaccugccccagggguucagcgcccucgagccccugguggaccugcccaucggcaucaacaucacccgguuccagacccuccuggcccugcaccgcuccuaccucaccccgggggacagcagcuccggcuggacggcgggcgccgccgccuacuacgugggguaccugcagccccggaccuuccugcucaaguacaacgagaacggcaccaucaccgacgcggucgacugcgcccuggacccccugagcgagacgaagugcacccucaaguccuucaccguggagaaggggaucuaccagaccagcaacuuccgcgugcagcccacggaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcucaacgaccugugcuucaccaacguguacgccgacuccuucgugauccgcggggacgagguccggcagaucgcccccggccagaccgggaagaucgccgacuacaacuacaagcugccggacgacuucaccggcugcgugaucgcguggaacagcaacaaccucgacuccaaggucgggggcaacuacaacuaccgguaccgccuguuccgcaagagcaaccugaagcccuucgagcgggacaucuccacggagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccaccaaccuggucaagaacaagugcgugaacuucaacuucaacggccugacggggaccggcgugcucaccgagagcaacaagaaguuccugccguuccagcaguucgggcgggacaucgccgacaccaccgacgcgguccgcgacccccagacgcuggagauccuggacaucacccccugcagcuucggcgggguguccgugaucaccccgggcaccaacacgagcaaccaggucgccgugcucuaccagggcgugaacugcaccgagguccccguggccauccacgccgaccagcugacccccaccuggcggguguacuccacggggagcaacgucuuccagacccgcgccggcugccugaucggggcggagcacgugaacaacuccuacgagugcgacauccccaucggcgccggcaucugcgccagcuaccagacccagaccaacucccggcgccgggcccgcagcguggcgucccagagcaucaucgccuacacgaugucccucggggccgagaacagcgucgccuacuccaacaacagcaucgccaucccgaccaacuucaccaucuccgugaccacggagauccugcccgugagcaugaccaagaccagcgucgacugcaccauguacaucugcggcgacuccacggagugcagcaaccugcuccugcaguacggguccuucugcacccagcugaaccgggcgcucaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugaccgugcugcccccgcuccugaccgacgagaugaucgcccaguacacgagcgcccugcucgcgggcaccaucaccuccggguggaccuucggcgccggcgccgcccugcagauccccuucgcgaugcagauggccuaccgcuucaacgggaucggcgucacgcagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacccuggugaagcagcucuccagcaacuucggggccaucuccagcgugcugaacgacauccugucccggcucgacccgcccgaggccgagguccagaucgaccgccugaucaccggccggcugcagagccuccagacguacgugacccagcagcugauccgcgcggccgagauccgggccagcgccaaccuggccgcgaccaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucaccacggcccccgccaucugccacgacggcaaggcccacuucccgcgggagggggucuucguguccaacggcacccacugguucgugacccagcgcaacuucuacgagccccagaucaucaccacggacaacaccuucgucagcggcaacugcgacguggugaucgggaucgucaacaacaccguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugacgaucaugcugugcugcaugaccagcugcugcuccugccucaagggcugcugcagcugcggguccugcugcaaguucgacgaggacgacagcgagcccgugcugaagggcgucaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27432 - RNA, 4085 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27433 - RNA, 4085 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27434 - RNA, 4085 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccgcgaccuguuccugcccuucuucagcaacgugaccugguuccacgugaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccacaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacucugggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27435 - RNA, 4085 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgugaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccacaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacucugggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27436 - RNA, 4094 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27437 - RNA, 4094 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27438 - RNA, 4094 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27439 - RNA, 4094 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggaugaagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcgugcagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccacgagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27440 - RNA, 4088 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagagucccgcagucggcguccagcggcucugcuuguucgugugugugucguugcaggccuuauucaagcuuaccauguucguguuccuggugcugcugccccuggugagcagccagugcgugaaccugcgcacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgagguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcagaacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27441 - RNA, 4073 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacgugaucaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcacgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccaguaccggcuguuccggaagagcaaccugaagcccuucgagcgggacaucagcaccgagaucuaccaagccggcuccaccccuugcaacggcguggagggcuucaacugcuacagcccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaacgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27442 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27443 - RNA, 4094 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguucuucgugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcggcagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27444 - RNA, 4094 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguucuucgugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcggcagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccgcgcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27445 - RNA, 4094 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgagcugcggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcuuccuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccacgacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27446 - RNA, 4094 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacuucagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccgugaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27447 - RNA, 4076 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaagcgccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacgccgugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccuguaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27448 - RNA, 4097 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcgugaccagcaaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccaccaaguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcagaacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27449 - RNA, 4103 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggaccgaccgcgaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggcaagacaggcaagaucgccgacuacaacuacaagcugcccgacgacuucaccggcugcgugaucgccuggaacagcaacaaccucgacagcaaggugggcggcaacuacaaguaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27450 - RNA, 4094 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcauggccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27451 - RNA, 4094 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccggaagggcguguucgugagcaacggcaccuacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27452 - RNA, 4088 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguucgacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugguggugcacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgccgagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccagcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcgcgacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcuggacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27453 - RNA, 4091 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27454 - RNA, 4088 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuccuggugcugcugccccuggugagcagccagugcgugaaccugcgcacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcgugcacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27455 - RNA, 4085 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27456 - RNA, 4085 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccauuugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27457 - RNA, 4085 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccgggaccuguuccugcccuucuucagcaacgugaccugguuccacgugaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgccaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugagggaccugccccagggauucagcgcucuggagccucugguggaccugcccaucggcaucaacaucacccgguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccacaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaggagguguucgcccaggugaagcaaaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggacccugggcgccggcgccgcacugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagccggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccucaugagcuuuccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27458 - RNA, 4085 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgugaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgccaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcucuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccacaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaggagguguucgcccaagugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggacccugggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccucaugagcuuuccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27459 - RNA, 4094 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcuucgugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27460 - RNA, 4094 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcuucgugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27461 - RNA, 4094 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27462 - RNA, 4094 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggaugaaguccgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacggugugcagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaagacaagaacacccaggagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccacgagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27463 - RNA, 4088 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagagucccgcagucggcguccagcggcucugcuuguucgugugugugucguugcaggccuuauucaagcuuaccauguucguguuccuggugcugcugccccuggugagcagccagugcgugaaccugcggacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcguguacuaccacaagaacaacaagagcuggauggagagcgaggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuucaacugcuacuuuccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacaccagcaaccagguggccgugcuguaccagggagugaacugcacagaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugacugugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcagaacguggugaaccagaacgcucaggcccugaacacccuggugaagcagcugagcagcaauuucggcgccaucagcucagugcugaacgacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuuuccccagagcgcuccccacggcgugguguuccugcacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27464 - RNA, 4073 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacgugaucaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgucuacuaccacaagaacaacaagagcuggauggagagcgaguuccggguguacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggcuucagcgcccuggagccucugguggaccugcccaucggaaucaacaucaccagguuccagacccugcuggcccugcacgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcauugugcgguuccccaacaucaccaaccugugucccuucggcgagguguucaacgccacucgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaagaucgccgacuacaacuacaagcugcccgacgacuucaccggcugcgugaucgccuggaacagcaacaaccuggacagcaaggugggcggcaacuacaacuaccaguaccggcuguuccguaagagcaaccugaagcccuucgagcgggacaucagcaccgagaucuaccaggccggcagcaccccaugcaacggcguggagggcuuuaacugcuacagcccccugcagagcuacgguuuccagcccaccaacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggauaucgccgacaccaccgacgcagugcgggacccccagacccuggagauccuggacaucacccccugcagcuucggcggcgucagcgugaucaccccaggcaccaacaccagcaaccagguggccgugcuguaccagggcgugaacugcacagaggugcccguggccauccacgccgaccagcugacccccaccuggcggguguacagcaccggcagcaacguguuccagacccgggccggaugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccauaagcgugaccaccgagauccugccugugagcaugaccaagaccagcguggacuguaccauguacaucugcggcgacagcaccgagugcagcaacuuacugcugcaguacggcagcuucugcacccagcugaaccgggcccugaccggcaucgccguggagcaagacaagaacacccaggagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgccgcucgggaccugaucugcgcccagaaguucaacggccugaacgugcugccuccccugcugacugacgagaugaucgcccaguacaccagcgcccugcuggccgggaccaucaccagcggcuggaccuucggcgccggcgcagcccugcagauccccuucgccaugcagauggccuaccgguucaacggcaucggcgugacccagaacgugcuuuacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcucagugcugaacgacauccugagccggcuggacccacccgaggccgaggugcagaucgacaggcugaucaccggccggcugcagagccugcagaccuacgugacccagcagcugauccgggccgccgagauucgggccagcgccaaccuggcagccaccaagaugagcgagugcgugcugggccagagcaagcggguggacuucugcggcaagggcuaccaccugaugagcuuuccccagagcgcuccccacggcgugguguuccugcacgucaccuacgugcccgcccaggagaagaacuucaccaccgcccccgccaucugccacgacggcaaggcccacuucccccgggagggcguguucgugagcaacggcacacacugguucgugacccagcggaacuucuacgagccccagaucaucaccaccgacaacaccuucgugagcggaaacugcgacguggugaucggcaucgugaacaacaccguguacgacccucugcagcccgagcucgacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27465 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27466 - RNA, 4094 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguucuucgugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuuuggcaccacccuggacagcaagacccagagccugcugaucgugaacaacgccacaaacguggugaucaaggugugcgaguuccaguucugcaacgaccccuuccugggcguguacuaccacaagaacaacaagagcuggauggagagcgaguuccgggucuacagcagcgcuaacaauugcaccuucgaguacgugagccagcccuuccugauggaccuggagggcaagcagggcaacuucaagaaccuccgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcggcagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcauugugcgguuccccaacaucacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccgguagcacccccugcaacggcgugaagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgauaccaccgacgcagugcgggacccccagacccuggagauccuggacaucaccccaugcagcuucggcggcgugagcgucaucacccccggaaccaacacaagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagaucuuacccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaucugaucugcgcucagaaguucaacggccugaccgugcugcccccucugcugaccgacgagaugaucgcccaguacaccagcgcccugcuggccggcaccaucaccagcggcuggaccuucggcgccggcgccgcacuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucaccuacgugcccgcccaggagaagaacuucacaaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27467 - RNA, 4094 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguucuucgugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuuuggcaccacccuggacagcaagacccagagccugcugaucgugaacaacgccacaaacguggugaucaaggugugcgaguuccaguucugcaacgaccccuuccugggcguguacuaccacaagaacaacaagagcuggauggagagcgaguuccgggucuacagcagcgcuaacaauugcaccuucgaguacgugagccagcccuuccugauggaccuggagggcaagcagggcaacuucaagaaccuccgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcggcagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcauugugcgguuccccaacaucacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccgguaacacccccugcaacggcguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggacaucgccgauaccaccgacgcagugcgggacccccagacccuggagauccuggacaucaccccaugcagcuucggcggcgugagcgucaucacccccggaaccaacacaagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcucgggaucugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcuagggcccugaacacccuggugaagcagcugagcagcaauuuuggcgccaucagcagcgugcugaacgacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27468 - RNA, 4094 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgagcugcgggucuacagcagcgcuaacaauugcaccuucgaguacgugagccagcccuuccucauggaccuggagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcuuccuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccacgacgugaacugcaccgaggugcccguggccauccacgccgaccagcugacccccaccuggcggguguacagcaccggaagcaacguguuccagacccgggccggcugcuuaaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaggagguguucgcccaagugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugccuccccugcugaccgacgagaugaucgcccaguacaccagcgcccuucuggccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccucaugagcuucccccagagcgcuccccacggcgugguguuccugcacgugacauacgugcccgcccaggagaagaacuucaccaccgcccccgccauuugccacgacggcaaggcccacuucccccgggagggcgucuucgugagcaacggaacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27469 - RNA, 4094 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacuucagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagccggcggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccgugaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgccgcucgggaccugaucugcgcccagaaguucaacgggcugaccgugcugccuccccugcugaccgacgagaugaucgcccaguacaccagcgcccugcuugccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcagcgugcugaaugacauccugucacggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27470 - RNA, 4076 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccagcgccuacaccaacagcuucacccggggcguguacuacccugacaagguguuccggagcagcgugcugcacagcacccaggaccuguuccugcccuucuucagcaacgugaccugguuccacgccaucagcggcaccaacggcaccaagcgguucgacaaccccgugcugccauucaacgacggcguguacuucgccagcaccgagaagucaaacaucauccggggcuggaucuucggcaccacccuggacagcaagacacagagccugcugaucgugaacaacgccaccaacgcugugaucaaggugugcgaguuucaguucugcaacgaccccuuccugggcguguaccacaagaacaacaagagcuggauggagagcgaguuccggguguacagcagcgccaacaauugcaccuucgaguacgugagccagcccuuccugauggaccucgagggcaagcagggcaacuucaagaaccugcgggaguucgucuucaagaacaucgauggcuacuucaagaucuacagcaagcacacccccaucaaccuggugcgggaccugccccagggauucagcgcccuggagccccugguggaccugccuaucggcaucaacaucaccagguuccagacccuguaccggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuucgagcgggacaucagcaccgagaucuaccaggccggcaacaccccaugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggccccaaaaagagcaccaaccuggugaagaacaagugcgugaauuucaacuucaacggccugaccggcaccggcgugcugaccgagagcaacaagaaguuccugccuuuccagcaguucggccgggauaucgccgacaccaccgacgcagugcgggacccccagacccuggagauccuggacaucacccccugcagcuucggcggcgugagcgugaucaccccaggcacaaacaccagcaaccagguggccguccuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagccugggcgccgagaacagcguggccuacagcaacaacagcaucgcgauccccaccaacuucaccaucagcgugaccaccgagauacugcccgugagcaugaccaagaccagcguggacuguaccauguacaucugcggcgacagcaccgagugcagcaacuuacugcugcaguacggcagcuucugcacccagcugaaccgggcccugaccggcaucgccguggagcaggacaagaacacccaagagguguucgcccaggugaagcagaucuacaagacuccucccaucaaggacuucggcggcuucaacuucagccagauccugcccgacccaagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccugcagauccccuucgccaugcagauggccuaccgguucaacggcaucggcgugacccagaacgugcuuuacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcucagugcugaacgacauccugagcaggcuggacccacccgaggccgaggugcagaucgaccggcugaucaccggccggcugcagagccugcagaccuacgugacccagcagcugauccgggccgccgagauccgggccagcgccaaccuggcagccauuaagaugagcgagugcgugcugggccagagcaagcggguggacuuuugcggcaagggcuaccaccugaugagcuucccccagagcgcuccccacggcgugguguuccugcacgugaccuacgugcccgcccaggagaagaacuucacaaccgcccccgccaucugccacgacggcaaggcccacuucccccgggagggaguguucgucagcaacggcacccacugguucgugacccagcggaacuucuacgagccccagaucaucaccacccacaacaccuucgugagcggcaacugcgacguggugaucggcaucgugaacaacaccguguacgacccccugcagccugagcucgacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27471 - RNA, 4097 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgugaccagcaaccacaagaacaacaagagcuggauggagagcgaguuccgggucuacagcagcgcuaauaacugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcauugugcgguuccccaacaucaccaaccugugucccuucggcgagguguucaacgccaccaaguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcuccaacguguuccagacccgggccggcugccugaucggcgccgagcacgugaacaacagcuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcagaacguggugaaccagaacgcucaggcccugaacacccuggugaagcagcugagcagcaauuucggcgccaucucaagcgugcugaacgacauccugagccggcuggacccacccgaggccgaggugcagaucgacaggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27472 - RNA, 4103 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcggaccgacagggaccugccccagggauucagcgcccuggagccucugguggaccugcccaucggcaucaacaucacccgguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagacuagcaacuuccgggugcagcccaccgagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggcaagaccggcaagaucgccgacuacaacuacaagcugcccgacgacuucaccggcugcgugaucgccuggaacagcaacaaccuggacagcaaggugggcggcaacuacaaguaccuguaccggcuguuccguaagagcaaccugaagccauucgagcgggauaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggacaucgccgacaccaccgacgcagugcgggacccccagacccuggagauccuggacaucaccccaugcagcuucggcggcgugagcgucaucacacccggcaccaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaucaacuucaccauaagcgugaccaccgagauccugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaggagguguucgcccaagugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggggacaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagccggcuggaucccccagaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27473 - RNA, 4094 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacacaagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcauggccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgcugcccgggaccugaucugcgcccagaaguucaacggccugacugugcugccuccccugcugaccgacgagaugaucgcccaguacaccagcgcccugcuugccggcaccaucaccagcggcuggaccuucggcgcaggcgccgcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcucugggcaagcugcaggacguggugaaccagaacgcccaggcccugaacacccuggugaagcagcugagcagcaacuucggcgccaucagcucagugcugaaugacauccugagcaggcuggacccacccgaggccgaggugcagaucgaccggcugaucaccggccggcugcagagccugcagaccuacgugacccagcagcugauccgggccgccgagauccgggccagcgcaaaccuggccgccaccaagaugagcgagugcgugcugggccagagcaagcggguggacuuuugcggcaagggcuaccaccugaugagcuucccccagagcgcuccccacggcgugguguuccuccacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27474 - RNA, 4094 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacccacccgaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccggaagggaguguucgugagcaacggcaccuacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcuucgugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27475 - RNA, 4088 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguucgacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccuggugguccacaagaacaacaagagcuggauggagagcgaguuccggguguacagcagcgcuaacaauugcaccuucgaguacgugagccagcccuuccugauggaucucgagggcaagcagggcaacuucaagaaccugcgggaguucguguucaagaacaucgacggcuacuucaagaucuacagcaagcacacccccaucaaccuggugcggggccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugccgagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgcagacaccaccgacgccgugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgcugaguacgugaacaacuccuacgagugcgacauccccaucggcgccagcaucugcgccagcuaccagacccagaccaacagcccccggcgggcccggagcguggccagccagagcaucaucgccuacaccaugagcuuaggcgccgagaacagcguggcguacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgcugcccgggaccugaucugcgcccagaaguucaacgggcugaccgugcugcccccucugcugaccgacgagaugaucgcccaguacaccagcgcccugcuugccggcaccaucaccagcggcuggaccuucggcgcaggcgccgcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcucugggcaagcugagggacguggugaaccagaacgcccaggcccugaacacccuggugaagcagcugagcagcaacuucggcgccaucucaagcgugcugaaugacauccugagccggcuggaucccccagaggccgaggugcagaucgaccggcugaucaccggccggcugcagagccugcagaccuacgugacccagcagcugauccgggccgccgagauccgggccagcgcaaaccuggccgccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcuggacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27476 - RNA, 4091 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacacaagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggcgacaucgccgcuagggaccugaucugcgcccagaaguucaacgggcugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugaccuacguccccgcccaggagaagaacuucacaaccgcccccgccauuugccacgacggcaaggcccacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27477 - RNA, 4088 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuccuggugcugcugccccuggugagcagccagugcgugaaccugcggacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgugcacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugagggaccugccccagggauucagcgcccuggagccucugguggaccugcccaucggcaucaacaucacccgguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacaccagcaaccagguggccgugcuguaccagggagugaacugcacagaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagaggagcuucaucgaggaccugcuguucaacaaggugacccuggccgacgccggcuucaucaagcaguacggcgacugccugggggauaucgccgcucgggaccugaucugcgcccagaaguucaacggccugacugugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27478 - RNA, 4085 nt, Artificial Sequence
  SARS-CoV-2/Wuhan/WIV05/2019__EPI_ISL_402128 spike protein mRNA gc mod (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27479 - RNA, 4085 nt, Artificial Sequence
  SARS-CoV-2/Wuhan/WIV05/2019__EPI_ISL_402128 spike protein mRNA gc mod (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27480 - RNA, 4085 nt, Artificial Sequence
  SARS-CoV-2/Wuhan/WIV05/2019__EPI_ISL_402128 spike protein mRNA gc mod (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccgcgaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacacacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27481 - RNA, 4085 nt, Artificial Sequence
  SARS-CoV-2/Wuhan/WIV05/2019__EPI_ISL_402128 spike protein mRNA gc mod (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacacacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27482 - RNA, 4094 nt, Artificial Sequence
  SARS-CoV-2/Wuhan/WIV05/2019__EPI_ISL_402128 spike protein mRNA gc mod (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27483 - RNA, 4094 nt, Artificial Sequence
  SARS-CoV-2/Wuhan/WIV05/2019__EPI_ISL_402128 spike protein mRNA gc mod (1-1273)(K986P_V987P_E484K_D614G_V1176F)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27484 - RNA, 4094 nt, Artificial Sequence
  SARS-CoV-2/Wuhan/WIV05/2019__EPI_ISL_402128 spike protein mRNA gc mod (1-1273)(K986P_V987P_L452R_D614G_P681R)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27485 - RNA, 4094 nt, Artificial Sequence
  SARS-CoV-2/Wuhan/WIV05/2019__EPI_ISL_402128 spike protein mRNA gc mod (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggaugaagagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcgugcagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucacgagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27486 - RNA, 4088 nt, Artificial Sequence
  SARS-CoV-2/Wuhan/WIV05/2019__EPI_ISL_402128 spike protein mRNA gc mod (1-1273)(K986P_V987P_T19R_F157del_R158del_L452R_T478K_D614G_P681R _D950N)
aggagagucccgcagucggcguccagcggcucugcuuguucgugugugugucguugcaggccuuauucaagcuuaccauguucguguuucuggugcugcugccccugguguccagccagugugugaaccugcgcaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27487 - RNA, 4073 nt, Artificial Sequence
  SARS-CoV-2/Wuhan/WIV05/2019__EPI_ISL_402128 spike protein mRNA gc mod (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaaugugaucaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccaguaccggcuguuccggaaguccaaucugaagcccuucgagcgggacaucagcaccgaaaucuaucaggccggcagcaccccuugcaacggcguggaaggcuucaacugcuacagcccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugaacgugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27488 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_N439K_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27489 - RNA, 4094 nt, Artificial Sequence
  SARS-CoV-2/Wuhan/WIV05/2019__EPI_ISL_402128 spike protein mRNA gc mod (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguuuuucgugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27490 - RNA, 4094 nt, Artificial Sequence
  SARS-CoV-2/Wuhan/WIV05/2019__EPI_ISL_402128 spike protein mRNA gc mod (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguuuuucgugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccgcgcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27491 - RNA, 4094 nt, Artificial Sequence
  SARS-CoV-2/Wuhan/WIV05/2019__EPI_ISL_402128 spike protein mRNA gc mod (1-1273)(K986P_V987P_F157L_V367F_Q613H_P681R)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagcugcggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccuuccuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccacgacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27492 - RNA, 4094 nt, Artificial Sequence
  SARS-CoV-2/Wuhan/WIV05/2019__EPI_ISL_402128 spike protein mRNA gc mod (1-1273)(K986P_V987P_S254F_D614G_P681R_G769V)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauuucagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagugaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27493 - RNA, 4076 nt, Artificial Sequence
  SARS-CoV-2/Wuhan/WIV05/2019__EPI_ISL_402128 spike protein mRNA gc mod (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuagcgccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacgccgucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacuguacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27494 - RNA, 4097 nt, Artificial Sequence
  SARS-CoV-2/Wuhan/WIV05/2019__EPI_ISL_402128 spike protein mRNA gc mod (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucaccagcaaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccaaguucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27495 - RNA, 4103 nt, Artificial Sequence
  SARS-CoV-2/Wuhan/WIV05/2019__EPI_ISL_402128 spike protein mRNA gc mod (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggaccgaccgcgaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggaaagacaggcaagaucgccgacuacaacuacaagcugcccgacgacuucaccggcugugugauugccuggaacagcaacaaccuggacuccaaagucggcggcaacuacaaguaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27496 - RNA, 4094 nt, Artificial Sequence
  SARS-CoV-2/Wuhan/WIV05/2019__EPI_ISL_402128 spike protein mRNA gc mod (1-1273)(K986P_V987P_T478K_D614G_P681H_T732A)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccauggccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27497 - RNA, 4094 nt, Artificial Sequence
  SARS-CoV-2/Wuhan/WIV05/2019__EPI_ISL_402128 spike protein mRNA gc mod (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagaaagggcguguucguguccaacggcaccuacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27498 - RNA, 4088 nt, Artificial Sequence
  SARS-CoV-2/Wuhan/WIV05/2019__EPI_ISL_402128 spike protein mRNA gc mod (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguucgacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccuggugguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgccgaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuagcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcgcgacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcuggacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27499 - RNA, 4091 nt, Artificial Sequence
  SARS-CoV-2/Wuhan/WIV05/2019__EPI_ISL_402128 spike protein mRNA gc mod (1-1273)(K986P_V987P_Y144del_L452R_T478K_P681R)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27500 - RNA, 4088 nt, Artificial Sequence
  SARS-CoV-2/Wuhan/WIV05/2019__EPI_ISL_402128 spike protein mRNA gc mod (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuucuggugcugcugccccugguguccagccagugugugaaccugcgcaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27501 - RNA, 4085 nt, Artificial Sequence
  SARS-CoV-2/Wuhan/WIV05/2019__EPI_ISL_402128 spike protein mRNA gc mod (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27502 - RNA, 4085 nt, Artificial Sequence
  SARS-CoV-2/Wuhan/WIV05/2019__EPI_ISL_402128 spike protein mRNA gc mod (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27503 - RNA, 4085 nt, Artificial Sequence
  SARS-CoV-2/Wuhan/WIV05/2019__EPI_ISL_402128 spike protein mRNA gc mod (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccgcgaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacacacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27504 - RNA, 4085 nt, Artificial Sequence
  SARS-CoV-2/Wuhan/WIV05/2019__EPI_ISL_402128 spike protein mRNA gc mod (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacacacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27505 - RNA, 4094 nt, Artificial Sequence
  SARS-CoV-2/Wuhan/WIV05/2019__EPI_ISL_402128 spike protein mRNA gc mod (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27506 - RNA, 4094 nt, Artificial Sequence
  SARS-CoV-2/Wuhan/WIV05/2019__EPI_ISL_402128 spike protein mRNA gc mod (1-1273)(K986P_V987P_E484K_D614G_V1176F)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27507 - RNA, 4094 nt, Artificial Sequence
  SARS-CoV-2/Wuhan/WIV05/2019__EPI_ISL_402128 spike protein mRNA gc mod (1-1273)(K986P_V987P_L452R_D614G_P681R)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27508 - RNA, 4094 nt, Artificial Sequence
  SARS-CoV-2/Wuhan/WIV05/2019__EPI_ISL_402128 spike protein mRNA gc mod (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggaugaagagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcgugcagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucacgagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27509 - RNA, 4088 nt, Artificial Sequence
  SARS-CoV-2/Wuhan/WIV05/2019__EPI_ISL_402128 spike protein mRNA gc mod (1-1273)(K986P_V987P_T19R_F157del_R158del_L452R_T478K_D614G_P681R _D950N)
aggagagucccgcagucggcguccagcggcucugcuuguucgugugugugucguugcaggccuuauucaagcuuaccauguucguguuccuggugcugcugccucugguguccagccagugugugaaccugcgcaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27510 - RNA, 4073 nt, Artificial Sequence
  SARS-CoV-2/Wuhan/WIV05/2019__EPI_ISL_402128 spike protein mRNA gc mod (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaaugugaucaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccaguaccggcuguuccggaaguccaaucugaagcccuucgagcgggacaucuccaccgagaucuaucaggccggcagcaccccuuguaacggcguggaaggcuucaacugcuacagcccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugaacgugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27511 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_N439K_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27512 - RNA, 4094 nt, Artificial Sequence
  SARS-CoV-2/Wuhan/WIV05/2019__EPI_ISL_402128 spike protein mRNA gc mod (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguucuucgugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27513 - RNA, 4094 nt, Artificial Sequence
  SARS-CoV-2/Wuhan/WIV05/2019__EPI_ISL_402128 spike protein mRNA gc mod (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguucuucgugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccgcgcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27514 - RNA, 4094 nt, Artificial Sequence
  SARS-CoV-2/Wuhan/WIV05/2019__EPI_ISL_402128 spike protein mRNA gc mod (1-1273)(K986P_V987P_F157L_V367F_Q613H_P681R)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagcugcggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccuuccuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccacgacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27515 - RNA, 4094 nt, Artificial Sequence
  SARS-CoV-2/Wuhan/WIV05/2019__EPI_ISL_402128 spike protein mRNA gc mod (1-1273)(K986P_V987P_S254F_D614G_P681R_G769V)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauuucagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagugaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27516 - RNA, 4076 nt, Artificial Sequence
  SARS-CoV-2/Wuhan/WIV05/2019__EPI_ISL_402128 spike protein mRNA gc mod (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuagcgccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacgccgucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacuguacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27517 - RNA, 4097 nt, Artificial Sequence
  SARS-CoV-2/Wuhan/WIV05/2019__EPI_ISL_402128 spike protein mRNA gc mod (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucaccagcaaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccaaguucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27518 - RNA, 4103 nt, Artificial Sequence
  SARS-CoV-2/Wuhan/WIV05/2019__EPI_ISL_402128 spike protein mRNA gc mod (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggaccgaccgcgaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggaaagacaggcaagaucgccgacuacaacuacaagcugcccgacgacuucaccggcugugugauugccuggaacagcaacaaccuggacuccaaagucggcggcaacuacaaguaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27519 - RNA, 4094 nt, Artificial Sequence
  SARS-CoV-2/Wuhan/WIV05/2019__EPI_ISL_402128 spike protein mRNA gc mod (1-1273)(K986P_V987P_T478K_D614G_P681H_T732A)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccauggccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27520 - RNA, 4094 nt, Artificial Sequence
  SARS-CoV-2/Wuhan/WIV05/2019__EPI_ISL_402128 spike protein mRNA gc mod (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagaaagggcguguucguguccaacggcaccuacugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27521 - RNA, 4088 nt, Artificial Sequence
  SARS-CoV-2/Wuhan/WIV05/2019__EPI_ISL_402128 spike protein mRNA gc mod (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguucgacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccuggugguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgccgaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuagcaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcgcgacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcuggacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27522 - RNA, 4091 nt, Artificial Sequence
  SARS-CoV-2/Wuhan/WIV05/2019__EPI_ISL_402128 spike protein mRNA gc mod (1-1273)(K986P_V987P_Y144del_L452R_T478K_P681R)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27523 - RNA, 4088 nt, Artificial Sequence
  SARS-CoV-2/Wuhan/WIV05/2019__EPI_ISL_402128 spike protein mRNA gc mod (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuccuggugcugcugccucugguguccagccagugugugaaccugcgcaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27524 - RNA, 4061 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27525 - RNA, 4061 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacagguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27526 - RNA, 4061 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccgcgaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27527 - RNA, 4061 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27528 - RNA, 4070 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27529 - RNA, 4070 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27530 - RNA, 4070 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27531 - RNA, 4070 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27532 - RNA, 4064 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N) R10824
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27533 - RNA, 4049 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcacgacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccaguaccgccuguuccgcaagagcaaccucaagcccuucgagcgggacaucuccaccgagaucuaccaggccggcagcacccccugcaacgggguggagggcuucaacugcuacagcccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27534 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27535 - RNA, 4070 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27536 - RNA, 4070 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccgcgcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27537 - RNA, 4070 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccacgacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27538 - RNA, 4070 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacuucagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggugaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27539 - RNA, 4052 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacgccgucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccucuaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27540 - RNA, 4073 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugaccagcaaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccaaguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27541 - RNA, 4079 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggaccgaccgcgaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggcaagaccgggaagaucgccgacuacaacuacaagcugccggacgacuucacgggcugcgugaucgcguggaacagcaacaaccucgacuccaaggucgggggcaacuacaaguaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27542 - RNA, 4070 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcauggccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27543 - RNA, 4070 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcaagggcguguucguguccaacgggaccuacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27544 - RNA, 4064 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguucgacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucguggugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccagcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcgcgacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccuggacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27545 - RNA, 4067 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27546 - RNA, 4064 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27547 - RNA, 4061 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27548 - RNA, 4061 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcaccgguccuaccucacgccgggcgacagcagcuccggcuggaccgcgggggccgccgccuacuacgugggcuaccugcagccccgcaccuuccugcucaaguacaacgagaacgggaccaucacggacgcggucgacugcgcccuggacccccugagcgagaccaagugcacccucaaguccuucaccguggagaagggcaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggggucagccccaccaagcucaacgaccugugcuucaccaacguguacgccgacuccuucgugauccgcggcgacgagguccggcagaucgcccccgggcagaccggcaacaucgccgacuacaacuacaagcugccggacgacuucacggggugcgugaucgcguggaacagcaacaaccucgacuccaaggugggcggcaacuacaacuaccuguaccgccuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccggguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgcgacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggcgccgggaucugcgccagcuaccagacgcagaccaacuccccgcggcgcgcccggagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgcgcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgguccuucaucgaggaccuccuguucaacaaggugacccuggccgacgccggguucaucaagcaguacggcgacugccucggggacaucgccgcgcgcgaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgguucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccuggggcagagcaagcggguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgcgagggcguguucguguccaacggcacccacugguucgucacgcagcggaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27549 - RNA, 4061 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccgggaccucuuccugcccuucuucagcaacgucacgugguuccacgugaucuccgggaccaacggcaccaagcgcuucgacaacccggugcugcccuucaacgacggggucuacuucgccagcaccgagaaguccaacaucauccggggcuggaucuucgggacgacccucgacagcaagacccagucccugcugaucgugaacaacgcgaccaacguggucaucaaggugugcgaguuccaguucugcaacgaccccuuccucggcguguaccacaagaacaacaagagcuggauggaguccgaguuccgcgucuacagcuccgccaacaacugcacguucgaguacgugagccagcccuuccugauggaccuggagggcaagcaggggaacuucaagaaccuccgggaguucguguucaagaacaucgacggcuacuucaagaucuacuccaagcacaccccgaucaaccugguccgcgaccugccccagggguucagcgcccucgagccccugguggaccugcccaucggcaucaacaucacccgguuccagacccuccuggcccugcaccgcuccuaccucacgccgggggacagcagcuccggcuggaccgccggcgcggccgccuacuacgugggguaccugcagccccggaccuuccugcucaaguacaacgagaacggcaccaucacggacgccgucgacugcgcgcuggacccccugagcgagaccaagugcacccucaaguccuucaccguggagaaggggaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccggcuguuccgcaagagcaaccucaagcccuucgagcgggacaucuccaccgagaucuaccaggcgggcagcacccccugcaacggggugaagggcuucaacugcuacuucccccugcaguccuacggguuccagccgaccaacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgggacccccagacccuggagauccucgacaucacccccugcagcuucggcgggguguccgugaucacgccgggcaccaacaccagcaaccaggucgcggugcuguaccagggcgugaacugcaccgagguccccguggccauccacgccgaccagcugacgcccaccuggcgcguguacuccaccgggagcaacgucuuccagacccgggccggcugccucaucggggccgagcacgugaacaacuccuacgagugcgacauccccaucggcgcgggcaucugcgccagcuaccagacgcacaccaacuccccgcgccgggcccgcagcguggccucccagagcaucaucgcguacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcccugacgggcaucgcgguggagcaggacaagaacacccaggagguguucgcccaggucaagcagaucuacaagacgcccccgaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccucggcgacaucgccgcgcgggaccugaucugcgcccagaaguucaacgggcugaccgugcucccgccccugcugaccgacgagaugaucgcccaguacaccagcgcccuccuggccggcaccaucacguccggguggacccugggcgcgggcgccgcccuccagauccccuucgccaugcagauggcguaccgcuucaacgggaucggcgucacccagaacgugcuguacgagaaccagaagcugaucgccaaccaguucaacagcgccaucgggaagauccaggacucccucagcuccaccgccagcgcccugggcaagcugcaggacguggucaaccagaacgcgcaggcccucaacacgcuggugaagcagcuguccagcaacuucggggccaucuccagcgugcucaacgacauccugucccggcuggacccgcccgaggccgagguccagaucgaccgccucaucaccggccggcugcagagccugcagaccuacgugacccagcagcucauccgcgccgcggagauccgggccagcgccaaccuggccgccaccaagauguccgagugcgugcugggccagagcaagcgcgucgacuucugcgggaagggcuaccaccucauguccuucccccagagcgcgccccacggggugguguuccugcacgucacguacgugcccgcccaggagaagaacuucaccaccgccccggccaucugccacgacggcaaggcgcacuucccccgggagggggucuucguguccaacggcacccacugguucgugacgcagcgcaacuucuacgagccccagaucaucaccaccgacaacaccuucgucagcggcaacugcgacguggugaucgggaucgucaacaacacgguguacgacccccugcagccggagcucgacuccuucaaggaggagcuggacaaguacuucaagaaccacaccagccccgacguggaccugggcgacaucuccgggaucaacgccagcgucgugaacauccagaaggagaucgaccggcucaacgagguggccaagaaccugaacgagucccugaucgaccuccaggagcugggcaaguacgagcaguacaucaaguggcccugguacaucuggcugggcuucaucgccgggcucaucgccaucgucauggugaccaucaugcugugcugcaugaccagcugcugcuccugccugaagggcugcugcagcugcggguccugcugcaaguucgacgaggacgacagcgagccggugcucaagggcgucaagcugcacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27550 - RNA, 4061 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgccagcaccgagaaguccaacaucauccgcggcuggaucuucgggacgacccucgacagcaagacccagucccugcugaucgugaacaacgcgaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcgggguguccgugaucacgccgggcaccaacaccagcaaccaggucgcggugcuguaccagggcgugaacugcaccgagguccccguggccauccacgccgaccagcugacgcccaccuggcggguguacuccaccgggagcaacgucuuccagacccgcgccggcugccucaucggggccgagcacgugaacaacuccuacgagugcgacauccccaucggcgcgggcaucugcgccagcuaccagacgcacaccaacuccccgcggcgcgcccggagcguggccucccagagcaucaucgcguacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcccugacgggcaucgcgguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccgugcucccgccccugcugaccgacgagaugaucgcccaguacaccagcgcccuccuggccggcaccaucacguccggguggacccugggcgcgggcgccgcccuccagauccccuucgccaugcagauggcguaccgguucaacgggaucggcgucacccagaacgugcuguacgagaaccagaagcugaucgccaaccaguucaacagcgccaucgggaagauccaggacucccucagcuccaccgccagcgcccugggcaagcugcaggacguggucaaccagaacgcgcaggcccucaacacgcuggugaagcagcuguccagcaacuucggggccaucuccagcgugcucaacgacauccugucccgccuggacccgcccgaggccgagguccagaucgaccggcucaucaccggccgccugcagagccugcagaccuacgugacccagcagcucauccgggccgcggagauccgcgccagcgccaaccuggccgccaccaagauguccgagugcgugcugggccagagcaagcgggucgacuucugcgggaagggcuaccaccucauguccuucccccagagcgcgccccacggggugguguuccugcacgucacguacgugcccgcccaggagaagaacuucaccaccgccccggccaucugccacgacggcaaggcgcacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcucgacuccuucaaggaggagcuggacaaguacuucaagaaccacaccagccccgacguggaccugggcgacaucuccgggaucaacgccagcgucgugaacauccagaaggagaucgaccgccucaacgagguggccaagaaccugaacgagucccugaucgaccuccaggagcugggcaaguacgagcaguacaucaaguggcccugguacaucuggcugggcuucaucgccgggcucaucgccaucgucauggugaccaucaugcugugcugcaugaccagcugcugcuccugccugaagggcugcugcagcugcggguccugcugcaaguucgacgaggacgacagcgagccggugcucaagggcgucaagcugcacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27551 - RNA, 4070 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcuucgucaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgugauggucaccaucaugcugugcugcaugaccagcugcugcuccugccucaagggcugcugcagcugcggguccugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27552 - RNA, 4070 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcuucgucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27553 - RNA, 4070 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcacccccugcaacgggguggagggcuucaacugcuacuucccccuccaguccuacggguuccagccgaccaacggcgugggguaccagcccuaccgcguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcgcguguacuccaccgggagcaacgucuuccagacccgggccggcugccugaucggggcggagcacgugaacaacuccuacgagugcgacauccccaucggcgccggcaucugcgccagcuaccagacgcagaccaacucccgccggcgcgcccggagcguggcgucccagagcaucaucgccuacaccaugucccucggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacccgcccgaggccgagguccagaucgaccggcugaucaccggccgccugcagagccuccagaccuacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucacguacgugcccgcccaggagaagaacuucaccaccgcccccgccaucugccacgacggcaaggcccacuucccgcgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27554 - RNA, 4070 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcacccccugcaacggggugcagggcuucaacugcuacuucccccuccaguccuacggguuccagccgaccaacggcgugggguaccagcccuaccgcguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcgcguguacuccaccgggagcaacgucuuccagacccgggccggcugccugaucggggcggagcacgugaacaacuccuacgagugcgacauccccaucggcgccggcaucugcgccagcuaccagacgcagaccaacucccgccggcgcgcccggagcguggcgucccagagcaucaucgccuacaccaugucccucggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacccgcccgaggccgagguccagaucgaccggcugaucaccggccgccugcagagccuccagaccuacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucacguacgugcccgcccacgagaagaacuucaccaccgcccccgccaucugccacgacggcaaggcccacuucccgcgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27555 - RNA, 4064 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagagucccgcagucggcguccagcggcucugcuuguucgugugugugucguugcaggccuuauucaagcuuaccauguucguguuccugguccuccugccccuggugagcucccagugcgugaaccuccgcacccggacccagcugccgcccgccuacacgaacagcuucacccgcggcgucuacuaccccgacaagguguuccgguccagcgugcugcacuccacccaggaccucuuccugcccuucuucagcaacgucaccugguuccacgccauccacguguccgggacgaacggcaccaagcgcuucgacaacccggugcugcccuucaacgacggggucuacuucgcgagcaccgagaaguccaacaucauccggggcuggaucuucgggaccacgcucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcaccuucgaguacgugagccagcccuuccugauggaccuggagggcaagcaggggaacuucaagaaccuccgcgaguucguguucaagaacaucgacggcuacuucaagaucuacuccaagcacacgccgaucaaccugguccgggaccugccccagggguucagcgcccucgagccccugguggaccugcccaucggcaucaacaucacccgcuuccagacccuccuggcccugcaccgguccuaccucaccccgggggacagcagcuccggcuggacggcgggcgccgccgccuacuacgugggguaccugcagccccgcaccuuccugcucaaguacaacgagaacggcaccaucaccgacgcggucgacugcgcccuggacccccugagcgagacgaagugcacccucaaguccuucaccguggagaaggggaucuaccagaccagcaacuuccgggugcagcccacggaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccaccuucaagugcuacggcgucagccccacgaagcucaacgaccugugcuucaccaacguguacgccgacuccuucgugauccgcggggacgagguccggcagaucgcccccggccagaccgggaagaucgccgacuacaacuacaagcugccggacgacuucaccggcugcgugaucgcguggaacagcaacaaccucgacuccaaggucgggggcaacuacaacuaccgcuaccggcuguuccgcaagagcaaccugaagcccuucgagcgggacaucuccacggagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccaccaaccuggucaagaacaagugcgugaacuucaacuucaacggccugacggggaccggcgugcucaccgagagcaacaagaaguuccugccguuccagcaguucgggcgcgacaucgccgacaccaccgacgcgguccgggacccccagacgcuggagauccuggacaucacccccugcagcuucggcgggguguccgugaucaccccgggcaccaacacgagcaaccaggucgccgugcucuaccagggcgugaacugcaccgagguccccguggccauccacgccgaccagcugacccccaccuggcgcguguacuccacggggagcaacgucuuccagacccgggccggcugccugaucggggcggagcacgugaacaacuccuacgagugcgacauccccaucggcgccggcaucugcgccagcuaccagacccagaccaacucccgccggcgcgcccggagcguggcgucccagagcaucaucgccuacacgaugucccucggggccgagaacagcgucgccuacuccaacaacagcaucgccaucccgaccaacuucaccaucuccgugaccacggagauccugcccgugagcaugaccaagaccagcgucgacugcaccauguacaucugcggcgacuccacggagugcagcaaccugcuccugcaguacggguccuucugcacccagcugaaccgcgcgcucaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugaccgugcugcccccgcuccugaccgacgagaugaucgcccaguacacgagcgcccugcucgcgggcaccaucaccuccggguggaccuucggcgccggcgccgcccugcagauccccuucgcgaugcagauggccuaccgguucaacgggaucggcgucacgcagaacgugcuguacgagaaccagaagcucaucgccaaccaguucaacagcgccaucgggaagauccaggacucccugagcuccaccgccagcgcgcugggcaagcuccagaacguggucaaccagaacgcccaggcccugaacacccuggugaagcagcucuccagcaacuucggggccaucuccagcgugcugaacgacauccugucccgccucgacccgcccgaggccgagguccagaucgaccggcugaucaccggccgccugcagagccuccagacguacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucaccuacgugcccgcccaggagaagaacuucaccacggcccccgccaucugccacgacggcaaggcccacuucccgcgcgagggggucuucguguccaacggcacccacugguucgugacccagcggaacuucuacgagccccagaucaucaccacggacaacaccuucgucagcggcaacugcgacguggugaucgggaucgucaacaacaccguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugacgaucaugcugugcugcaugaccagcugcugcuccugccucaagggcugcugcagcugcggguccugcugcaaguucgacgaggacgacagcgagcccgugcugaagggcgucaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27556 - RNA, 4049 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccgguccugcccuucaacgacggcguguacuucgcgagcaccgagaaguccaacaucauccgcggguggaucuucggcaccacgcucgacagcaagacccagucccugcugaucgugaacaacgccaccaacgucgugaucaaggugugcgaguuccaguucugcaacgaccccuuccucggggucuacuaccacaagaacaacaagagcuggauggaguccgaguuccggguguacagcuccgccaacaacugcaccuucgaguacgugagccagcccuuccugauggaccuggagggcaagcagggcaacuucaagaaccuccgcgaguucgucuucaagaacaucgacggguacuucaagaucuacuccaagcacacgccgaucaaccuggugcgggaccugccccagggcuucagcgcccucgagccccugguggaccugcccaucgggaucaacaucacccgcuuccagacccuccuggcccugcacgacuccagcagcggcuggaccgcgggggccgccgccuacuacgucggcuaccuccagccgcggacguuccugcugaaguacaacgagaacggcaccaucaccgacgcgguggacugcgcccucgacccccuguccgagaccaagugcacgcucaagagcuucaccguggagaaggggaucuaccagaccuccaacuuccgcguccagcccaccgagagcaucgugcgguuccccaacaucacgaaccucugcccguucggcgaggucuucaacgccacccgcuucgccuccguguacgccuggaaccggaagcgcaucagcaacugcguggcggacuacuccguccuguacaacagcgccuccuucagcaccuucaagugcuacggggugucccccaccaagcugaacgaccucugcuucacgaacguguacgccgacagcuucgucauccggggcgacgaggugcgccagaucgcccccggccagaccgggaagaucgccgacuacaacuacaagcugcccgacgacuucaccggcugcgugaucgcguggaacuccaacaaccuggacagcaaggucgggggcaacuacaacuaccaguaccggcuguuccgcaaguccaaccugaagccguucgagcgggacaucagcaccgagaucuaccaggccggguccacgcccugcaacggcguggagggcuucaacugcuacagcccccugcaguccuacggguuccagcccaccaacggcgugggguaccagccguaccgcgucguggugcucagcuucgagcugcugcacgcccccgccaccgucugcggccccaagaaguccaccaaccucgugaagaacaagugcgugaacuucaacuucaacgggcugacgggcaccggcguccugaccgaguccaacaagaaguuccuccccuuccagcaguucgggcgggacaucgccgacaccaccgacgcggugcgcgacccgcagacgcuggagauccuggacaucacccccugcagcuucggcgggguguccgucaucacccccggcaccaacacgagcaaccagguggccgugcuguaccagggggucaacugcaccgaggugccgguggccauccacgccgaccagcucacccccaccuggcgcgucuacuccacgggcagcaacguguuccagacccgggccggcugccugaucggggcggagcacgugaacaacuccuacgagugcgacauccccaucggcgccgggaucugcgccagcuaccagacccagaccaacagcccccgccgggcccgcagcgucgcgucccagagcaucaucgccuacacgaugucccugggcgccgagaacagcguggccuacuccaacaacagcaucgccaucccgaccaacuucaccaucuccgugaccacggagauccuccccgucagcaugaccaagaccagcguggacugcaccauguacaucugcggcgacuccacggagugcagcaaccugcugcuccaguacggguccuucugcacccagcugaaccgggcgcugaccggcaucgccguggagcaggacaagaacacccaggaggucuucgcccaggugaagcagaucuacaagacgccgcccaucaaggacuucgggggcuucaacuucagccagauccuccccgaccccuccaagcccagcaagcgcuccuucaucgaggaccugcuguucaacaaggugacccucgccgacgccggguucaucaagcaguacggcgacugccugggcgacaucgcggcccgggaccugaucugcgcccagaaguucaacgggcucaacguccugcccccgcugcucaccgacgagaugaucgcccaguacaccagcgcccugcuggcgggcacgaucaccuccggguggaccuucggcgccggggccgcccuccagauccccuucgcgaugcagauggccuaccgcuucaacggcaucggcgugacccagaacgugcuguacgagaaccagaagcugaucgccaaccaguucaacagcgccaucgggaagauccaggacucccucagcuccacggccagcgcgcugggcaagcugcaggacgucgugaaccagaacgcccaggcccucaacacccuggugaagcagcuguccagcaacuucggggccaucuccagcguccucaacgacauccugucccggcuggacccgcccgaggccgaggugcagaucgaccgccucaucaccggccggcugcagagccugcagaccuacgugacgcagcagcucauccgcgcggccgagauccgggccagcgccaaccuggccgcgaccaagauguccgagugcguccuggggcagagcaagcgcguggacuucugcggcaagggcuaccaccucauguccuucccccagagcgcgccccacgggguggucuuccugcacgugaccuacguccccgcccaggagaagaacuucaccaccgcccccgccaucugccacgacggcaaggcccacuucccgcgggaggggguguucguguccaacggcacgcacugguucgucacccagcgcaacuucuacgagccccagaucaucaccaccgacaacacguucgugagcgggaacugcgacguggucaucggcaucgugaacaacaccguguacgacccccugcagcccgagcucgacuccuucaaggaggagcuggacaaguacuucaagaaccacaccagcccggacgucgaccugggcgacaucuccgggaucaacgccagcguggugaacauccagaaggagaucgaccggcucaacgaggucgccaagaaccugaacgagucccugaucgaccuccaggagcugggcaaguacgagcaguacaucaaguggcccugguacaucuggcugggguucaucgccggccucaucgcgaucgugauggugaccaucaugcugugcugcaugacgagcugcugcuccugccugaagggcugcugcagcugcggguccugcugcaaguucgacgaggacgacagcgagcccguccucaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27557 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27558 - RNA, 4070 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccucauggaccuggagggcaagcaggggaacuucaagaaccugcgcgaguucguguucaagaacaucgacggcuacuucaagaucuacuccaagcacacgccgaucaaccucguccgggaccugccccagggguucagcgcccuggagccccucguggaccugcccaucggcaucaacaucacccgcuuccagacccugcucgcccugcaccgguccuaccugacccccgggggcagcagcuccggcuggacggcgggggccgccgccuacuacgugggcuaccuccagccccgcaccuuccugcugaaguacaacgagaacgggaccaucaccgacgcggucgacugcgcccucgacccccugagcgagacgaagugcacccugaaguccuucaccguggagaagggcaucuaccagaccagcaacuuccgggugcagcccacggaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccaccuucaagugcuacggggucagccccacgaagcugaacgaccucugcuucaccaacguguacgccgacuccuucgugauccgcggcgacgagguccggcagaucgcccccgggcagaccggcaagaucgccgacuacaacuacaagcugccggacgacuucaccgggugcgugaucgcguggaacagcaacaaccuggacuccaaggugggcggcaacuacaacuaccucuaccgccuguuccgcaagagcaaccugaagcccuucgagcgggacaucuccacggagaucuaccaggccgggagcacccccugcaacggcgucaagggguucaacugcuacuucccccuccaguccuacggcuuccagccgaccaacggggugggcuaccagcccuaccggguggucgugcugagcuucgagcugcuccacgcccccgccaccgugugcggccccaagaaguccacgaaccuggucaagaacaagugcgugaacuucaacuucaacgggcugaccggcaccggggugcucaccgagagcaacaagaaguuccugccguuccagcaguucggccgcgacaucgccgacaccacggacgcgguccgcgacccccagacccuggagauccuggacaucacccccugcagcuucgggggcguguccgugaucaccccgggcacgaacaccagcaaccaggucgccgugcucuaccagggggugaacugcaccgagguccccguggccauccacgccgaccagcugacccccacguggcggguguacuccaccggcagcaacgucuuccagacccgcgccgggugccugaucggcgcggagcacgugaacaacuccuacgagugcgacauccccaucggcgccgggaucugcgccagcuaccagacccagacgaacuccccgcggcgcgcccggagcguggcgucccagagcaucaucgccuacaccaugucccucggcgucgagaacagcguggccuacuccaacaacagcaucgccauccccaccaacuucaccaucuccgugacgaccgagauccugcccgucagcaugaccaagaccagcguggacugcacgauguacaucugcggggacuccaccgagugcagcaaccugcuccugcaguacggcuccuucugcacccagcugaaccgcgcccucaccgggaucgcgguggagcaggacaagaacacgcaggaggucuucgcccaggugaagcagaucuacaagacgcccccgaucaaggacuucggcggcuucaacuucagccagauccugcccgaccccuccaagcccagcaagcgguccuucaucgaggaccuccuguucaacaaggugacccuggccgacgccggguucaucaagcaguacggcgacugccugggggacaucgccgcgcgcgaccucaucugcgcccagaaguucaacggccugaccguccugccgccccuccugaccgacgagaugaucgcccaguacaccagcgcccugcucgccgggaccaucaccuccggcuggacguucggcgcgggggccgcccugcagauccccuucgccaugcagauggcguaccgguucaacggcaucggggugacccagaacgugcuguacgagaaccagaagcucaucgccaaccaguucaacagcgccaucggcaagauccaggacucccugagcuccaccgccagcgcccuggggaagcuccaggacgucgugaaccagaacgcgcaggcccugaacacccuggugaagcagcucuccagcaacuucggcgccaucuccagcguccugaacgacauccugucccgccucgacccgccggaggccgaggugcagaucgaccggcugaucacgggccgccugcagagccuccagaccuacgugacccagcagcugauccgggccgcggagauccgcgccagcgccaaccuggccgccaccaagauguccgagugcguccucgggcagagcaagcggguggacuucugcggcaagggguaccaccugauguccuucccccagagcgcgccccacggcguggucuuccugcacgugaccuacguccccgcccaggagaagaacuucacgaccgccccggccaucugccacgacgggaaggcgcacuucccccgcgagggcguguucguguccaacggcacccacugguucgucacccagcggaacuucuacgagccccagaucaucacgaccgacaacaccuucgugagcgggaacugcgacguggucaucggcaucgugaacaacaccguguacgacccccuccagccggagcuggacuccuucaaggaggagcuggacaaguacuucaagaaccacacgagccccgacgucgaccucggggacaucuccggcaucaacgccagcguggugaacauccagaaggagaucgaccgccugaacgaggucgccaagaaccugaacgagucccucaucgaccugcaggagcugggcaaguacgagcaguacaucaaguggcccugguacaucuggcucggguucaucgccggccugaucgccaucgugauggugaccaucaugcugugcugcaugaccagcugcugcuccugccucaaggggugcugcagcugcggcuccugcugcaaguucgacgaggacgacagcgagccgguccugaagggggugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27559 - RNA, 4070 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccucauggaccuggagggcaagcaggggaacuucaagaaccugcgcgaguucguguucaagaacaucgacggcuacuucaagaucuacuccaagcacacgccgaucaaccucguccgggaccugccccagggguucagcgcccuggagccccucguggaccugcccaucggcaucaacaucacccgcuuccagacccugcucgcccugcaccgguccuaccugacccccgggggcagcagcuccggcuggacggcgggggccgccgccuacuacgugggcuaccuccagccccgcaccuuccugcugaaguacaacgagaacgggaccaucaccgacgcggucgacugcgcccucgacccccugagcgagacgaagugcacccugaaguccuucaccguggagaagggcaucuaccagaccagcaacuuccgggugcagcccacggaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccaccuucaagugcuacggggucagccccacgaagcugaacgaccucugcuucaccaacguguacgccgacuccuucgugauccgcggcgacgagguccggcagaucgcccccgggcagaccggcaagaucgccgacuacaacuacaagcugccggacgacuucaccgggugcgugaucgcguggaacagcaacaaccuggacuccaaggugggcggcaacuacaacuaccucuaccgccuguuccgcaagagcaaccugaagcccuucgagcgggacaucuccacggagaucuaccaggccgggaacacccccugcaacggcgucgagggguucaacugcuacuucccccuccagagcuacggcuuccagccgaccaacggggugggcuaccagcccuaccggguggucgugcuguccuucgagcugcuccacgcccccgccaccgugugcggccccaagaaguccacgaaccuggucaagaacaagugcgugaacuucaacuucaacgggcugaccggcaccggggugcucaccgagagcaacaagaaguuccugccguuccagcaguucggccgcgacaucgccgacaccacggacgcgguccgcgacccccagacccuggagauccuggacaucacccccugcagcuucgggggcgugagcgugaucaccccgggcacgaacaccuccaaccaggucgccgugcucuaccagggggugaacugcaccgagguccccguggccauccacgccgaccagcugacccccacguggcggguguacagcaccggcuccaacgucuuccagacccgcgccgggugccugaucggcgcggagcacgugaacaacagcuacgagugcgacauccccaucggcgccgggaucugcgccuccuaccagacccagacgaacagcccgcggcgcgcccgguccguggcgagccaguccaucaucgccuacaccaugagccucggcgccgagaacuccgucgccuacagcaacaacuccaucgccauccccaccaacuucaccaucagcgugacgaccgagauccugcccguguccaugaccaagaccagcgucgacugcacgauguacaucugcggggacagcaccgagugcuccaaccugcuccugcaguacggcagcuucugcacccagcugaaccgcgcgcucaccgggaucgccguggagcaggacaagaacacgcaggagguguucgcccaggucaagcagaucuacaagacgcccccgaucaaggacuucggcggcuucaacuucucccagauccugcccgaccccagcaagcccuccaagcggagcuucaucgaggaccuccuguucaacaaggugacccuggccgacgccggguucaucaagcaguacggcgacugccugggggacaucgcggcccgcgaccucaucugcgcccagaaguucaacggccugaccgugcugccgccccuccugaccgacgagaugaucgcccaguacaccuccgcccugcucgcggggaccaucaccagcggcuggacguucggcgccggggccgcccugcagauccccuucgcgaugcagauggccuaccgguucaacggcaucggggucacccagaacgugcuguacgagaaccagaagcucaucgccaaccaguucaacuccgccaucggcaagauccaggacagccuguccagcaccgccuccgcgcuggggaagcuccaggacguggucaaccagaacgcccgcgcccugaacacccuggugaagcagcucagcuccaacuucggcgccaucagcuccgugcugaacgacauccugagccggcucgacccgccggaggccgagguccagaucgaccgccugaucacgggccggcugcagucccuccagaccuacgugacccagcagcugauccgcgcggccgagauccgggccagcgccaaccuggccgcgaccaagaugagcgagugcgugcucgggcaguccaagcgcgucgacuucugcggcaagggguaccaccugaugagcuucccccaguccgcgccccacggcgugguguuccugcacgucaccuacgugcccgcccaggagaagaacuucacgaccgccccggccaucugccacgacgggaaggcccacuucccccgggagggcgucuucgugagcaacggcacccacugguucgugacccagcgcaacuucuacgagccccagaucaucacgaccgacaacaccuucgucuccgggaacugcgacguggugaucggcaucgucaacaacaccguguacgacccccuccagccggagcuggacagcuucaaggaggagcuggacaaguacuucaagaaccacacgucccccgacguggaccucggggacaucagcggcaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggguucaucgccggccugaucgcgaucgucauggugaccaucaugcugugcugcaugaccuccugcugcagcugccucaaggggugcugcuccugcggcagcugcugcaaguucgacgaggacgacuccgagccggugcugaagggggucaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27560 - RNA, 4070 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccucgagggcaagcaggggaacuucaagaaccugcgcgaguucguguucaagaacaucgacggcuacuucaagaucuacuccaagcacaccccgaucaaccugguccgggaccucccccagggguucagcgcccuggagccccugguggaccuccccaucggcaucaacaucacccgcuuccagacccugcuggcccuccaccgguccuaccugacgccgggggacagcagcuccggcuggaccgcgggcgccgccgccuacuacgugggguaccugcagccccgcaccuuccuccugaaguacaacgagaacggcaccaucacggacgcggucgacugcgcccuggacccccucagcgagaccaagugcacccugaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccucuacaacuccgccagcuucuccacguucaagugcuacggcgugagccccaccaagcugaacgaccugugcuucaccaacgucuacgccgacuccuucgugauccgcggggacgaggugcggcagaucgcccccggccagaccgggaagaucgccgacuacaacuacaagcucccggacgacuucacgggcugcgucaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccucagcuucgagcugcugcacgcccccgccacggugugcggccccaagaaguccaccaaccucgugaagaacaagugcgucaacuucaacuucaacggccugaccgggaccggcgugcugaccgagagcaacaagaaguuccugccguuccagcaguucgggcgcgacaucgccgacacgaccgacgcggugcgcgacccccagacccucgagauccuggacaucacccccugcagcuucggcggggucuccgugaucacgccgggcaccaacaccagcaaccagguggccguccuguaccacgacgugaacugcaccgaggugcccgucgccauccacgccgaccagcucacgcccaccuggcggguguacuccaccggcagcaacguguuccagacccgcgccgggugccugaucggcgcggagcacgucaacaacuccuacgagugcgacauccccaucggggccggcaucugcgccagcuaccagacgcagaccaacucccggcgccgggcccgcagcguggcgucccagagcaucaucgccuacaccaugucccugggcgccgagaacagcguggccuacuccaacaacagcaucgccaucccgaccaacuucacgaucuccgucaccaccgagauccuccccgugagcaugaccaagacgagcguggacugcaccauguacaucugcggggacuccaccgagugcagcaaccugcugcuccaguacggcuccuucugcacccagcugaaccgggcgcugacggggaucgccgucgagcaggacaagaacacccaggagguguucgcccaggugaagcagaucuacaagaccccgcccaucaaggacuucggcggguucaacuucagccagauccuccccgaccccuccaagcccagcaagcgcuccuucaucgaggaccugcuguucaacaaggucacccucgccgacgccggcuucaucaagcaguacggcgacugccugggggacaucgcggcccgggaccugaucugcgcccagaaguucaacggccucacggugcugcccccgcugcucaccgacgagaugaucgcccaguacaccagcgcccugcuggcggggaccaucacguccggcuggaccuucggggccggcgccgcccuccagauccccuucgcgaugcagauggccuaccgcuucaacggcaucggggugacccagaacguccuguacgagaaccagaagcugaucgccaaccaguucaacagcgccaucggcaagauccaggacucccucagcuccaccgccagcgcgcuggggaagcugcaggacguggugaaccagaacgcccaggcccucaacacgcuggucaagcagcuguccagcaacuucggcgccaucuccagcgugcucaacgacauccugucccggcuggacccgcccgaggccgaggugcagaucgaccgccucaucaccgggcggcugcagagccugcagaccuacgucacccagcagcucauccgcgcggccgagauccgggccagcgccaaccuggccgcgaccaagauguccgagugcgugcugggccagagcaagcgcguggacuucugcggcaagggguaccaccucauguccuucccccagagcgcgccccacggcgucguguuccugcacgugacguacguccccgcccaggagaagaacuucaccaccgcccccgccaucugccacgacgggaaggcccacuucccgcgggagggcguguucgucuccaacgggacccacugguucgugacgcagcgcaacuucuacgagccccagaucaucaccaccgacaacaccuucgugagcggcaacugcgacgucgugaucggcaucgugaacaacacggucuacgacccccugcagcccgagcucgacuccuucaaggaggagcuggacaaguacuucaagaaccacaccagcccggacguggaccugggggacaucuccggcaucaacgccagcguggucaacauccagaaggagaucgaccggcucaacgagguggccaagaaccugaacgagucccugaucgaccuccaggagcuggggaaguacgagcaguacaucaaguggcccugguacaucuggcugggcuucaucgccggccucaucgcgaucgugauggucaccaucaugcugugcugcaugaccagcugcugcuccugccugaaggggugcugcagcugcggcuccugcugcaaguucgacgaggacgacagcgagcccgugcucaagggggugaagcugcacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27561 - RNA, 4070 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacuucagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccgccuguuccggaaguccaaccucaagcccuucgagcgcgacaucagcaccgagaucuaccaggccggcuccacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagccggcgccgggcccgcuccguggcgagccaguccaucaucgccuacaccaugagccugggggccgagaacuccgucgccuacagcaacaacuccaucgccaucccgaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgggcgcugacggugaucgccguggagcaggacaagaacacccaggaggucuucgcccaggugaagcagaucuacaagaccccgcccaucaaggacuucggcggguucaacuucucccagauccugcccgaccccagcaagcccuccaagcgcagcuucaucgaggaccuccuguucaacaaggugacccuggccgacgccggcuucaucaagcaguacggcgacugccucggggacaucgcggcccgggaccugaucugcgcccagaaguucaacggccugacgguccugcccccgcuccugaccgacgagaugaucgcccaguacaccuccgcccuccuggcggggaccaucacgagcggcuggaccuucggggccggcgccgcccugcagauccccuucgcgaugcagauggccuaccgcuucaacggcaucggggugacccagaacgugcucuacgagaaccagaagcugaucgccaaccaguucaacuccgccaucggcaagauccaggacagccuguccagcaccgccuccgcgcucgggaagcugcaggacgucgugaaccagaacgcccaggcccugaacacgcucgugaagcagcugagcuccaacuucggcgccaucagcuccguccugaacgacauccucagccggcuggacccgcccgaggccgaggugcagaucgaccgccugaucaccgggcggcuccagucccugcagaccuacgugacccagcagcugauccgcgcggccgagauccgggccagcgccaaccucgccgcgaccaagaugagcgagugcguccugggccaguccaagcgcguggacuucugcggcaagggguaccaccugaugagcuucccccaguccgcgccccacggcguggucuuccuccacgugacguacguccccgcccaggagaagaacuucaccaccgcccccgccaucugccacgacgggaaggcccacuucccgcgggagggcguguucgugagcaacgggacccacugguucgucacgcagcgcaacuucuacgagccccagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccuccccggacgucgaccugggggacaucagcggcaucaacgccuccguggugaacauccagaaggagaucgaccggcugaacgaggucgccaagaaccucaacgagagccugaucgaccugcaggagcucgggaaguacgagcaguacaucaaguggcccugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27562 - RNA, 4052 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgagcgccuacaccaacuccuucacccggggcgucuacuaccccgacaagguguuccgcagcuccgugcugcacagcacccaggaccucuuccugcccuucuucuccaacgucacgugguuccacgccaucagcgggaccaacggcaccaagcgguucgacaaccccgugcugccguucaacgacgggguguacuucgcguccaccgagaaguccaacaucauccgcggcuggaucuucgggacgacccucgacagcaagacccagagccugcugaucgucaacaacgccaccaacgccgugaucaaggugugcgaguuccaguucugcaacgaccccuuccucggcgucuaccacaagaacaacaaguccuggauggagagcgaguuccggguguacuccagcgccaacaacugcacguucgaguacgugucccagcccuuccugauggaccuggagggcaagcaggggaacuucaagaaccuccgcgaguucgucuucaagaacaucgacggcuacuucaagaucuacagcaagcacacccccaucaaccuggugcgggaccugccgcagggguucuccgcccucgagccccugguggaccugcccaucggcaucaacaucacccgcuuccagacccucuaccggagcuaccugacgcccggggacagcuccagcggcuggaccgcgggcgccgccgccuacuacgucggguaccugcagccgcgcaccuuccuccugaaguacaacgagaacggcaccaucacggacgcgguggacugcgcccuggacccccucuccgagaccaagugcacccucaagagcuucaccguggagaaggggaucuaccagacguccaacuuccggguccagcccaccgagagcaucgugcgcuuccccaacaucaccaaccugugcccguucggcgagguguucaacgccacccgguucgccuccgucuacgccuggaaccgcaagcggaucagcaacugcguggcggacuacuccguccuguacaacagcgccuccuucagcacguucaagugcuacggcgugucccccaccaagcugaacgaccugugcuucaccaacguguacgccgacagcuucgucauccgcggggacgaggugcggcagaucgcccccggccagaccgggaagaucgccgacuacaacuacaagcuccccgacgacuucacgggcugcgugaucgcguggaacuccaacaaccuggacagcaaggucgggggcaacuacaacuaccuguaccgccucuuccggaaguccaaccugaagccguucgagcgcgacaucagcaccgagaucuaccaggccggcaacacccccugcaacggggugaagggcuucaacugcuacuucccccugcaguccuacggguuccagcccaccaacggcgugggguaccagccguaccgggucguggugcucagcuucgagcugcugcacgcccccgccacggucugcggccccaagaaguccaccaaccucgugaagaacaagugcgugaacuucaacuucaacggccugaccgggaccggcguccugaccgagagcaacaagaaguuccuccccuuccagcaguucgggcgcgacaucgccgacacgaccgacgcggugcgcgacccgcagacccuggagauccuggacaucacccccugcagcuucggcgggguguccgucaucacgcccggcaccaacaccagcaaccagguggccgugcuguaccagggcgucaacugcaccgaggugccgguggccauccacgccgaccagcucacgcccaccuggcgggucuacuccaccgggagcaacguguuccagacccgcgccggcugccugaucggggcggagcacgugaacaacuccuacgagugcgacauccccaucggcgccggcaucugcgccagcuaccagacgcagaccaacucccaccggcgcgcccggagcgucgcgucccagagcaucaucgccuacaccaugucccugggggccgagaacagcguggccuacuccaacaacagcaucgccauccccaccaacuucacgaucuccgugaccaccgagauccucccggucagcaugaccaagacgagcguggacugcaccauguacaucugcggcgacuccaccgagugcagcaaccugcugcuccaguacggguccuucugcacccagcugaaccgcgcgcugacgggcaucgccguggagcaggacaagaacacccaggaggucuucgcccaggugaagcagaucuacaagaccccgcccaucaaggacuucgggggcuucaacuucagccagauccuccccgaccccuccaagcccagcaagcgguccuucaucgaggaccugcuguucaacaaggugacccucgccgacgccggcuucaucaagcaguacggggacugccugggcgacaucgcggcccgcgaccugaucugcgcccagaaguucaacgggcucacgguccugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgugacccagaacgugcuguacgagaaccagaagcugaucgccaaccaguucaacagcgccaucgggaagauccaggacucccucagcuccaccgccagcgcgcugggcaagcugcaggacgucgugaaccagaacgcccaggcccucaacacgcuggugaagcagcuguccagcaacuucggggccaucuccagcguccucaacgacauccugucccgccuggacccgcccgaggccgaggugcagaucgaccggcucaucaccggccgccugcagagccugcagaccuacgugacccagcagcucauccgggcggccgagauccgcgccagcgccaaccuggccgcgaucaagauguccgagugcguccugggccagagcaagcggguggacuucugcgggaagggcuaccaccucauguccuucccccagagcgcgccccacgggguggucuuccugcacgugaccuacgugcccgcccaggagaagaacuucacgaccgcccccgccaucugccacgacggcaaggcccacuucccccgcgagggggucuucguguccaacggcacccacugguucgucacccagcggaacuucuacgagccgcagaucaucacgacccacaacaccuucgugagcggcaacugcgacguggucaucgggaucgugaacaacaccguguacgacccccugcagcccgagcucgacuccuucaaggaggagcuggacaaguacuucaagaaccacacgagccccgacgucgaccugggcgacaucuccgggaucaacgccagcguggugaacauccagaaggagaucgaccgccucaacgaggucgccaagaaccugaacgagucccugaucgaccuccaggagcugggcaaguacgagcaguacaucaaguggccgugguacaucuggcugggcuucaucgccgggcucaucgcgaucgugauggugaccaucaugcugugcugcaugaccagcugcugcuccugccugaagggcugcugcagcugcggguccugcugcaaguucgacgaggacgacagcgagcccguccucaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27563 - RNA, 4073 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcucgacagcaagacccagucccugcugaucgugaacaacgccaccaacguggucaucaaggugugcgaguuccaguucugcaacgaccccuuccucggcgugaccagcaaccacaagaacaacaaguccuggauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacagcuccagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccaccaaguucgccuccgucuacgccuggaaccggaagcgcaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccggcuguuccgcaaguccaaccucaagcccuucgagcgggacaucagcaccgagaucuaccaggccggcuccacccccugcaacggggugaagggcuucaacugcuacuucccccugcagagcuacggguuccagccgaccuacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgggacaucgccgacacgaccgacgcgguccgcgacccccagacccuggagauccucgacaucacccccugcuccuucggcggggugagcgugaucacgccgggcaccaacaccuccaaccaggucgccgugcuguaccagggcgugaacugcaccgagguccccguggccauccacgccgaccagcugacgcccaccuggcgcguguacagcaccggguccaacgucuuccagacccgggccggcugccucaucggggcggagcacgugaacaacagcuacgagugcgacauccccaucggcgccggcaucugcgccuccuaccagacgcagaccaacagccaccgccgggcccgcuccguggcgagccaguccaucaucgccuacaccaugagccugggggccgagaacuccgucgccuacagcaacaacuccaucgccaucccgaccaacuucacgaucagcgugaccaccgagauccugcccgugagcaugaccaagacguccgucgacugcaccauguacaucugcggcgacagcaccgagugcuccaaccuccugcugcaguacgggagcuucugcacccagcucaaccgggcgcugacgggcaucgccguggagcaggacaagaacacccaggagguguucgcccaggucaagcagaucuacaagaccccgcccaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccucggcgacaucgcggcccgggaccugaucugcgcccagaaguucaacgggcugacggugcugcccccgcuccugaccgacgagaugaucgcccaguacaccuccgcccuccuggcgggcaccaucacgagcggguggaccuucggcgccggcgccgcccugcagauccccuucgcgaugcagauggccuaccgcuucaacgggaucggcgucacccagaacgugcucuacgagaaccagaagcugaucgccaaccaguucaacuccgccaucgggaagauccaggacagccuguccagcaccgccuccgcgcucggcaagcugcagaacguggucaaccagaacgcccaggcccugaacacgcucgugaagcagcugagcuccaacuucggggccaucagcuccgugcugaacgacauccucagccggcuggacccgcccgaggccgagguccagaucgaccgccugaucaccggccggcuccagagccugcagaccuacgugacccagcagcugauccgcgcggccgagauccgggccuccgccaaccucgccgcgaccaagaugagcgagugcgugcugggccaguccaagcgcgucgacuucugcgggaagggcuaccaccugaugagcuucccccaguccgcgccccacggggugguguuccuccacgucacguacgugcccgcccaggagaagaacuucaccaccgcccccgccaucugccacgacggcaaggcccacuucccgcgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccugcagcccgagcuggacagcuucaaggaggagcucgacaaguacuucaagaaccacaccuccccggacguggaccugggcgacaucagcgggaucaacgccuccgucgugaacauccagaaggagaucgaccggcugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagcccgugcugaagggcgucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27564 - RNA, 4079 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggaccgaccgcgaccugccccagggguucagcgcccucgagccccugguggaccugcccaucggcaucaacaucacccgguuccagacgcuccuggcccugcaccgcuccuaccucaccccgggggacagcagcuccggcuggaccgcgggcgccgccgccuacuacgugggguaccugcagccccggaccuuccugcucaaguacaacgagaacggcacgaucaccgacgcggucgacugcgcccuggacccccugagcgagaccaagugcacccucaaguccuucacgguggagaaggggaucuaccagaccagcaacuuccgcgugcagcccaccgaguccaucguccgguucccgaacaucaccaaccugugccccuucggcgagguguucaacgccacgcgcuucgccagcgucuacgccuggaaccggaagcgcaucuccaacugcguggcggacuacagcgugcuguacaacuccgccagcuucuccaccuucaagugcuacggcgucagccccaccaagcucaacgaccugugcuucaccaacguguacgccgacuccuucgugauccgcggggacgagguccggcagaucgcccccggcaagacggggaagaucgccgacuacaacuacaagcugccggacgacuucaccggcugcgugaucgcguggaacagcaacaaccucgacuccaaggucgggggcaacuacaaguaccuguaccggcuguuccgcaagagcaaccucaagcccuucgagcgggacaucuccaccgagaucuaccaggccggcagcacccccugcaacgggguggagggcuucaacugcuacuucccccugcaguccuacggguuccagccgacgaacggcgugggguaccagcccuaccgcguggucgugcugagcuucgagcuccugcacgcccccgccaccgugugcggccccaagaaguccaccaaccuggucaagaacaagugcgugaacuucaacuucaacggccucaccgggaccggcgugcugacggagagcaacaagaaguuccugccguuccagcaguucgggcgcgacaucgccgacaccaccgacgcgguccgggacccccagacccuggagauccucgacaucacgcccugcagcuucggcgggguguccgugaucaccccgggcaccaacaccagcaaccaggucgccgugcuguaccagggcgugaacugcacggagguccccguggccauccacgccgaccagcugacccccaccuggcgcguguacuccaccgggagcaacgucuuccagacgcgggccggcugccucaucggggcggagcacgugaacaacuccuacgagugcgacauccccaucggcgccggcaucugcgccagcuaccagacccagaccaacuccccgcgccgggcccgcagcguggcgucccagagcaucaucgccuacaccaugucccugggggccgagaacagcgucgccuacuccaacaacagcaucgccauccccaucaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccucggcgacaucgcggcccgggaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgcuucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccggcuggacccgcccgaggccgagguccagaucgaccgccugaucaccggccggcuccagagccugcagaccuacgugacccagcagcugauccgcgcggccgagauccgggccagcgccaaccucgccgcgaccaagauguccgagugcgugcugggccagagcaagcgcgucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgggagggggucuucguguccaacggcacccacugguucgugacgcagcgcaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccggcugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27565 - RNA, 4070 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccaccgugugcggccccaagaaguccacgaaccuggucaagaacaagugcgugaacuucaacuucaacggccucaccgggaccggcgugcugaccgagagcaacaagaaguuccugccguuccagcaguucgggcgcgacaucgccgacaccacggacgcgguccgcgacccccagacccuggagauccucgacaucacccccugcagcuucggcgggguguccgugaucaccccgggcacgaacaccagcaaccaggucgccgugcuguaccagggcgugaacugcaccgagguccccguggccauccacgccgaccagcugacccccacguggcggguguacuccaccgggagcaacgucuuccagacccgcgccggcugccucaucggggcggagcacgugaacaacuccuacgagugcgacauccccaucggcgccggcaucugcgccagcuaccagacccagacgaacucccaccggcgcgcccggagcguggcgucccagagcaucaucgccuacaccaugucccugggggccgagaacagcgucgccuacuccaacaacagcaucgccaucccgaccaacuucaccaucuccgugacgaccgagauccugcccgugagcauggcgaagaccagcgucgacugcaccauguacaucugcggcgacuccacggagugcagcaaccuccugcugcaguacggguccuucugcacccagcucaaccgcgcccugaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgguccuucaucgaggaccuccuguucaacaaggugacccuggccgacgcgggcuucaucaagcaguacggggacugccucggcgacaucgccgcccgcgaccugaucugcgcccagaaguucaacgggcugaccgugcugcccccgcuccugaccgacgagaugaucgcccaguacacgagcgcgcuccuggccggcaccaucaccuccggguggaccuucggcgccggcgccgcgcugcagauccccuucgccaugcagauggccuaccgguucaacgggaucggcgucacgcagaacgugcucuacgagaaccagaagcugaucgccaaccaguucaacagcgccaucgggaagauccaggacucccugagcuccaccgcgagcgcccucggcaagcugcaggacguggucaaccagaacgcccaggcccugaacacccucgugaagcagcuguccagcaacuucggggccaucuccagcgugcugaacgacauccucucccgccuggacccgcccgaggcggagguccagaucgaccggcugaucaccggccgccuccagagccugcagacguacgugacccagcagcugauccgggccgccgagauccgcgccagcgccaaccucgcggccaccaagauguccgagugcgugcugggccagagcaagcgggucgacuucugcgggaagggcuaccaccugauguccuucccccagagcgcgccccacggggugguguuccuccacgucaccuacgugcccgcccaggagaagaacuucaccacggcccccgccaucugccacgacggcaaggcccacuucccgcgcgagggggucuucguguccaacggcacccacugguucgugacccagcggaacuucuacgagccccagaucaucaccacggacaacaccuucgucagcggcaacugcgacguggugaucgggaucgucaacaacaccguguacgacccccugcagcccgagcuggacuccuucaaggaggagcucgacaaguacuucaagaaccacaccagcccggacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgcggggcugaucgccaucgucauggugacgaucaugcucugcugcaugaccagcugcugcuccugccugaagggcugcugcagcugcggguccugcugcaaguucgacgaggacgacagcgagcccgugcugaagggcgucaagcuccacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27566 - RNA, 4070 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacucccaccggcgcgcccggagcguggcgucccagagcaucaucgccuacaccaugucccugggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugacggugcugcccccgcuccugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgcccccgccaucugccacgacggcaaggcccacuucccgcgcaagggggucuucguguccaacggcaccuacugguucgugacgcagcggaacuucuacgagccccagaucaucaccaccgacaacaccuucgucagcggcaacugcgacguggugaucgggaucgucaacaacacgguguacgacccccugcagcccgagcuggacuccuucaaggaggagcucgacaaguacuucaagaaccacaccagcccggacguggaccugggcgacaucuccgggaucaacgccagcuucgucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27567 - RNA, 4064 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguucgacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgugguccacaagaacaacaagagcuggauggaguccgaguuccggguguacagcuccgccaacaacugcacguucgaguacgugagccagcccuuccugauggaccuggagggcaagcagggcaacuucaagaaccuccgcgaguucgucuucaagaacaucgacggguacuucaagaucuacuccaagcacaccccgaucaaccuggugcggggccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgucggguaccugcagccccgcaccuuccugcucaaguacaacgagaacggcaccaucacggacgcgguggacugcgcccuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggcggacuacagcguccuguacaacuccgccagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgcggacacgaccgacgccguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgcgggcugccucaucggggccgaguacgugaacaacuccuacgagugcgacauccccaucggcgccagcaucugcgccuccuaccagacgcagaccaacagcccgcggcgcgcgcgguccguggccagccaguccaucaucgccuacaccaugagccugggcgccgagaacuccgucgccuacagcaacaacuccaucgcgauccccaccaacuucacgaucagcgugaccaccgagauccugcccgugagcaugaccaagacguccgucgacugcaccauguacaucugcggggacagcaccgagugcuccaaccuccugcugcaguacggcagcuucugcacccagcucaaccgcgcccugacggggaucgccguggagcaggacaagaacacccaggagguguucgcccaggucaagcagaucuacaagacgcccccgaucaaggacuucggcggguucaacuucucccagauccugcccgaccccagcaagcccuccaagcggagcuucaucgaggaccuccuguucaacaaggugacccuggccgacgcgggcuucaucaagcaguacggcgacugccucggggacaucgccgcccgcgaccugaucugcgcccagaaguucaacggccugaccgugcucccgccccugcugaccgacgagaugaucgcccaguacaccuccgcgcuccuggccgggaccaucacgagcggcuggaccuucggggccggcgccgcgcugcagauccccuucgccaugcagauggccuaccgguucaacggcaucggggucacccagaacgugcucuacgagaaccagaagcugaucgccaaccaguucaacuccgccaucggcaagauccaggacagccuguccagcaccgcguccgcccucgggaagcugcgcgacguggucaaccagaacgcccaggcccugaacacgcucgugaagcagcugagcuccaacuucggcgccaucagcuccgugcugaacgacauccucagccggcuggacccgcccgaggcggagguccagaucgaccgccugaucaccgggcggcuccagagccugcagaccuacgugacccagcagcugauccgcgccgccgagauccgggccuccgccaaccucgcggccaccaagaugagcgagugcgugcugggccaguccaagcgcgucgacuucugcggcaagggguaccaccugaugagcuucccccaguccgcgccccacggcgugguguuccuccacgucacguacgugcccgcccaggagaagaacuucaccaccgccccggccaucugccacgacgggaaggcccacuucccccgggagggcgucuucgugagcaacgggacccacugguucgugacgcagcgcaacuucuacgagccccagaucaucaccaccgacaacaccuucgucuccggcaacugcgacguggugaucggcaucgucaacaacacgguguacgacccccugcagccggagcuggacagcuucaaggaggagcucgacaaguacuucaagaaccacaccucccccgacguggaccugggggacaucagcggcaucaacgccuccgucgugaacauccagaaggagaucgaccggcuggacgagguggccaagaaccucaacgagagccugaucgaccugcaggagcucgggaaguacgagcaguacaucaaguggcccugguacaucuggcugggcuucaucgcgggccugaucgccaucgucauggugaccaucaugcucugcugcaugaccuccugcugcagcugccugaaggggugcugcuccugcggcagcugcugcaaguucgacgaggacgacuccgagccggugcugaagggggucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27568 - RNA, 4067 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccacgaaccuggucaagaacaagugcgugaacuucaacuucaacggccugaccgggaccggcgugcucaccgagagcaacaagaaguuccugccguuccagcaguucgggcgcgacaucgccgacaccacggacgcgguccgggacccccagacccuggagauccuggacaucacccccugcagcuucggcgggguguccgugaucaccccgggcacgaacaccagcaaccaggucgccgugcucuaccaggacgugaacugcaccgagguccccguggccauccacgccgaccagcugacccccacguggcgcguguacuccaccggcagcaacgucuuccagacccgggccgggugccugaucggcgcggagcacgugaacaacuccuacgagugcgacauccccaucggggccggcaucugcgccagcuaccagacccagacgaacucccgccggcgcgcccggagcguggcgucccagagcaucaucgccuacaccaugucccucggcgccgagaacagcgucgccuacuccaacaacagcaucgccaucccgaccaacuucaccaucuccgugacgaccgagauccugcccgugagcaugaccaagaccagcgucgacugcacgauguacaucugcggggacuccaccgagugcagcaaccugcuccugcaguacggcuccuucugcacccagcugaaccgcgcgcucaccgggaucgccguggagcaggacaagaacacgcaggagguguucgcccaggucaagcagaucuacaagaccccgcccaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccugggggacaucgcggcccgcgaccucaucugcgcccagaaguucaacggccugaccgugcugcccccgcuccugacggacgagaugaucgcccaguacaccagcgcccugcucgcggggaccaucaccuccggcuggacguucggggccggcgccgcccugcagauccccuucgcgaugcagauggccuaccgguucaacggcaucggggucacccagaacgugcuguacgagaaccagaagcucaucgccaaccaguucaacagcgccaucggcaagauccaggacucccugagcuccaccgccagcgcgcuggggaagcuccaggacguggucaaccagaacgcccaggcccugaacacccuggugaagcagcucuccagcaacuucggcgccaucuccagcgugcugaacgacauccugucccgccucgacccgcccgaggccgagguccagaucgaccggcugaucacggggcgccugcagagccuccagaccuacgugacccagcagcugauccgggcggccgagauccgcgccagcgccaaccuggccgcgaccaagauguccgagugcgugcucggccagagcaagcgggucgacuucugcggcaagggguaccaccugauguccuucccccagagcgcgccccacggcgugguguuccugcacgucaccuacgugcccgcccaggagaagaacuucacgaccgcccccgccaucugccacgacgggaaggcccacuucccgcgcgagggcgucuucguguccaacgggacccacugguucgugacccagcggaacuucuacgagccccagaucaucacgaccgacaacaccuucgucagcggcaacugcgacguggugaucggcaucgucaacaacaccguguacgacccccuccagcccgagcuggacuccuucaaggaggagcuggacaaguacuucaagaaccacacgagcccggacguggaccucggggacaucuccggcaucaacgccagcgucgugaacauccagaaggagaucgaccgccugaacgagguggccaagaaccugaacgagucccucaucgaccugcaggagcuggggaaguacgagcaguacaucaaguggcccugguacaucuggcucggcuucaucgccggccugaucgcgaucgucauggugaccaucaugcugugcugcaugaccagcugcugcuccugccucaaggggugcugcagcugcggcuccugcugcaaguucgacgaggacgacagcgagcccgugcugaagggggucaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27569 - RNA, 4064 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuccugguccuccugccccuggugagcucccagugcgugaaccuccgcacccggacccagcugccgcccgccuacacgaacagcuucacccgcggcgucuacuaccccgacaagguguuccgguccagcgugcugcacuccacccaggaccucuuccugcccuucuucagcaacgucaccugguuccacgccauccacguguccgggacgaacggcaccaagcgcuucgacaacccggugcugcccuucaacgacggggucuacuucgcgagcaccgagaaguccaacaucauccggggcuggaucuucgggaccacgcucgacagcaagacccagucccugcugaucgugaacaacgccaccaacguggucaucaaggugugcgaguuccaguucugcaacgaccccuuccucggcgugcacaagaacaacaagagcuggauggaguccgaguuccgcgucuacagcuccgccaacaacugcaccuucgaguacgugagccagcccuuccugauggaccuggagggcaagcaggggaacuucaagaaccuccgggaguucguguucaagaacaucgacggcuacuucaagaucuacuccaagcacacgccgaucaaccugguccgcgaccugccccagggguucagcgcccucgagccccugguggaccugcccaucggcaucaacaucacccgguuccagacccuccuggcccugcaccgcuccuaccucaccccgggggacagcagcuccggcuggacggcgggcgccgccgccuacuacgugggguaccugcagccccggaccuuccugcucaaguacaacgagaacggcaccaucaccgacgcggucgacugcgcccuggacccccugagcgagacgaagugcacccucaaguccuucaccguggagaaggggaucuaccagaccagcaacuuccgcgugcagcccacggaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcucaacgaccugugcuucaccaacguguacgccgacuccuucgugauccgcggggacgagguccggcagaucgcccccggccagaccgggaagaucgccgacuacaacuacaagcugccggacgacuucaccggcugcgugaucgcguggaacagcaacaaccucgacuccaaggucgggggcaacuacaacuaccgguaccgccuguuccgcaagagcaaccugaagcccuucgagcgggacaucuccacggagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccaccaaccuggucaagaacaagugcgugaacuucaacuucaacggccugacggggaccggcgugcucaccgagagcaacaagaaguuccugccguuccagcaguucgggcgggacaucgccgacaccaccgacgcgguccgcgacccccagacgcuggagauccuggacaucacccccugcagcuucggcgggguguccgugaucaccccgggcaccaacacgagcaaccaggucgccgugcucuaccagggcgugaacugcaccgagguccccguggccauccacgccgaccagcugacccccaccuggcggguguacuccacggggagcaacgucuuccagacccgcgccggcugccugaucggggcggagcacgugaacaacuccuacgagugcgacauccccaucggcgccggcaucugcgccagcuaccagacccagaccaacucccggcgccgggcccgcagcguggcgucccagagcaucaucgccuacacgaugucccucggggccgagaacagcgucgccuacuccaacaacagcaucgccaucccgaccaacuucaccaucuccgugaccacggagauccugcccgugagcaugaccaagaccagcgucgacugcaccauguacaucugcggcgacuccacggagugcagcaaccugcuccugcaguacggguccuucugcacccagcugaaccgggcgcucaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugaccgugcugcccccgcuccugaccgacgagaugaucgcccaguacacgagcgcccugcucgcgggcaccaucaccuccggguggaccuucggcgccggcgccgcccugcagauccccuucgcgaugcagauggccuaccgcuucaacgggaucggcgucacgcagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacccuggugaagcagcucuccagcaacuucggggccaucuccagcgugcugaacgacauccugucccggcucgacccgcccgaggccgagguccagaucgaccgccugaucaccggccggcugcagagccuccagacguacgugacccagcagcugauccgcgcggccgagauccgggccagcgccaaccuggccgcgaccaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucaccacggcccccgccaucugccacgacggcaaggcccacuucccgcgggagggggucuucguguccaacggcacccacugguucgugacccagcgcaacuucuacgagccccagaucaucaccacggacaacaccuucgucagcggcaacugcgacguggugaucgggaucgucaacaacaccguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugacgaucaugcugugcugcaugaccagcugcugcuccugccucaagggcugcugcagcugcggguccugcugcaaguucgacgaggacgacagcgagcccgugcugaagggcgucaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27570 - RNA, 4061 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27571 - RNA, 4061 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27572 - RNA, 4061 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccgcgaccuguuccugcccuucuucagcaacgugaccugguuccacgugaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccacaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacucugggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27573 - RNA, 4061 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgugaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccacaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacucugggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27574 - RNA, 4070 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27575 - RNA, 4070 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27576 - RNA, 4070 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27577 - RNA, 4070 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggaugaagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcgugcagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccacgagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27578 - RNA, 4064 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagagucccgcagucggcguccagcggcucugcuuguucgugugugugucguugcaggccuuauucaagcuuaccauguucguguuccuggugcugcugccccuggugagcagccagugcgugaaccugcgcacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgagguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcagaacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27579 - RNA, 4049 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacgugaucaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcacgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccaguaccggcuguuccggaagagcaaccugaagcccuucgagcgggacaucagcaccgagaucuaccaagccggcuccaccccuugcaacggcguggagggcuucaacugcuacagcccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaacgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27580 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27581 - RNA, 4070 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguucuucgugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcggcagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27582 - RNA, 4070 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguucuucgugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcggcagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccgcgcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27583 - RNA, 4070 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgagcugcggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcuuccuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccacgacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27584 - RNA, 4070 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacuucagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccgugaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27585 - RNA, 4052 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaagcgccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacgccgugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccuguaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27586 - RNA, 4073 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcgugaccagcaaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccaccaaguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcagaacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27587 - RNA, 4079 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggaccgaccgcgaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggcaagacaggcaagaucgccgacuacaacuacaagcugcccgacgacuucaccggcugcgugaucgccuggaacagcaacaaccucgacagcaaggugggcggcaacuacaaguaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27588 - RNA, 4070 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcauggccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27589 - RNA, 4070 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccggaagggcguguucgugagcaacggcaccuacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27590 - RNA, 4064 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguucgacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugguggugcacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgccgagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccagcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcgcgacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcuggacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27591 - RNA, 4067 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27592 - RNA, 4064 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuccuggugcugcugccccuggugagcagccagugcgugaaccugcgcacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcgugcacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27593 - RNA, 4061 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27594 - RNA, 4061 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccauuugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27595 - RNA, 4061 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccgggaccuguuccugcccuucuucagcaacgugaccugguuccacgugaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgccaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugagggaccugccccagggauucagcgcucuggagccucugguggaccugcccaucggcaucaacaucacccgguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccacaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaggagguguucgcccaggugaagcaaaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggacccugggcgccggcgccgcacugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagccggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccucaugagcuuuccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27596 - RNA, 4061 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgugaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgccaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcucuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccacaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaggagguguucgcccaagugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggacccugggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccucaugagcuuuccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27597 - RNA, 4070 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcuucgugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27598 - RNA, 4070 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcuucgugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27599 - RNA, 4070 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27600 - RNA, 4070 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggaugaaguccgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacggugugcagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaagacaagaacacccaggagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccacgagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27601 - RNA, 4064 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagagucccgcagucggcguccagcggcucugcuuguucgugugugugucguugcaggccuuauucaagcuuaccauguucguguuccuggugcugcugccccuggugagcagccagugcgugaaccugcggacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcguguacuaccacaagaacaacaagagcuggauggagagcgaggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuucaacugcuacuuuccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacaccagcaaccagguggccgugcuguaccagggagugaacugcacagaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugacugugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcagaacguggugaaccagaacgcucaggcccugaacacccuggugaagcagcugagcagcaauuucggcgccaucagcucagugcugaacgacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuuuccccagagcgcuccccacggcgugguguuccugcacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27602 - RNA, 4049 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacgugaucaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgucuacuaccacaagaacaacaagagcuggauggagagcgaguuccggguguacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggcuucagcgcccuggagccucugguggaccugcccaucggaaucaacaucaccagguuccagacccugcuggcccugcacgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcauugugcgguuccccaacaucaccaaccugugucccuucggcgagguguucaacgccacucgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaagaucgccgacuacaacuacaagcugcccgacgacuucaccggcugcgugaucgccuggaacagcaacaaccuggacagcaaggugggcggcaacuacaacuaccaguaccggcuguuccguaagagcaaccugaagcccuucgagcgggacaucagcaccgagaucuaccaggccggcagcaccccaugcaacggcguggagggcuuuaacugcuacagcccccugcagagcuacgguuuccagcccaccaacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggauaucgccgacaccaccgacgcagugcgggacccccagacccuggagauccuggacaucacccccugcagcuucggcggcgucagcgugaucaccccaggcaccaacaccagcaaccagguggccgugcuguaccagggcgugaacugcacagaggugcccguggccauccacgccgaccagcugacccccaccuggcggguguacagcaccggcagcaacguguuccagacccgggccggaugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccauaagcgugaccaccgagauccugccugugagcaugaccaagaccagcguggacuguaccauguacaucugcggcgacagcaccgagugcagcaacuuacugcugcaguacggcagcuucugcacccagcugaaccgggcccugaccggcaucgccguggagcaagacaagaacacccaggagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgccgcucgggaccugaucugcgcccagaaguucaacggccugaacgugcugccuccccugcugacugacgagaugaucgcccaguacaccagcgcccugcuggccgggaccaucaccagcggcuggaccuucggcgccggcgcagcccugcagauccccuucgccaugcagauggccuaccgguucaacggcaucggcgugacccagaacgugcuuuacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcucagugcugaacgacauccugagccggcuggacccacccgaggccgaggugcagaucgacaggcugaucaccggccggcugcagagccugcagaccuacgugacccagcagcugauccgggccgccgagauucgggccagcgccaaccuggcagccaccaagaugagcgagugcgugcugggccagagcaagcggguggacuucugcggcaagggcuaccaccugaugagcuuuccccagagcgcuccccacggcgugguguuccugcacgucaccuacgugcccgcccaggagaagaacuucaccaccgcccccgccaucugccacgacggcaaggcccacuucccccgggagggcguguucgugagcaacggcacacacugguucgugacccagcggaacuucuacgagccccagaucaucaccaccgacaacaccuucgugagcggaaacugcgacguggugaucggcaucgugaacaacaccguguacgacccucugcagcccgagcucgacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27603 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27604 - RNA, 4070 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguucuucgugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuuuggcaccacccuggacagcaagacccagagccugcugaucgugaacaacgccacaaacguggugaucaaggugugcgaguuccaguucugcaacgaccccuuccugggcguguacuaccacaagaacaacaagagcuggauggagagcgaguuccgggucuacagcagcgcuaacaauugcaccuucgaguacgugagccagcccuuccugauggaccuggagggcaagcagggcaacuucaagaaccuccgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcggcagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcauugugcgguuccccaacaucacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccgguagcacccccugcaacggcgugaagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgauaccaccgacgcagugcgggacccccagacccuggagauccuggacaucaccccaugcagcuucggcggcgugagcgucaucacccccggaaccaacacaagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagaucuuacccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaucugaucugcgcucagaaguucaacggccugaccgugcugcccccucugcugaccgacgagaugaucgcccaguacaccagcgcccugcuggccggcaccaucaccagcggcuggaccuucggcgccggcgccgcacuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucaccuacgugcccgcccaggagaagaacuucacaaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27605 - RNA, 4070 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguucuucgugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuuuggcaccacccuggacagcaagacccagagccugcugaucgugaacaacgccacaaacguggugaucaaggugugcgaguuccaguucugcaacgaccccuuccugggcguguacuaccacaagaacaacaagagcuggauggagagcgaguuccgggucuacagcagcgcuaacaauugcaccuucgaguacgugagccagcccuuccugauggaccuggagggcaagcagggcaacuucaagaaccuccgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcggcagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcauugugcgguuccccaacaucacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccgguaacacccccugcaacggcguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggacaucgccgauaccaccgacgcagugcgggacccccagacccuggagauccuggacaucaccccaugcagcuucggcggcgugagcgucaucacccccggaaccaacacaagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcucgggaucugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcuagggcccugaacacccuggugaagcagcugagcagcaauuuuggcgccaucagcagcgugcugaacgacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27606 - RNA, 4070 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgagcugcgggucuacagcagcgcuaacaauugcaccuucgaguacgugagccagcccuuccucauggaccuggagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcuuccuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccacgacgugaacugcaccgaggugcccguggccauccacgccgaccagcugacccccaccuggcggguguacagcaccggaagcaacguguuccagacccgggccggcugcuuaaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaggagguguucgcccaagugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugccuccccugcugaccgacgagaugaucgcccaguacaccagcgcccuucuggccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccucaugagcuucccccagagcgcuccccacggcgugguguuccugcacgugacauacgugcccgcccaggagaagaacuucaccaccgcccccgccauuugccacgacggcaaggcccacuucccccgggagggcgucuucgugagcaacggaacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27607 - RNA, 4070 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacuucagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagccggcggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccgugaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgccgcucgggaccugaucugcgcccagaaguucaacgggcugaccgugcugccuccccugcugaccgacgagaugaucgcccaguacaccagcgcccugcuugccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcagcgugcugaaugacauccugucacggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27608 - RNA, 4052 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccagcgccuacaccaacagcuucacccggggcguguacuacccugacaagguguuccggagcagcgugcugcacagcacccaggaccuguuccugcccuucuucagcaacgugaccugguuccacgccaucagcggcaccaacggcaccaagcgguucgacaaccccgugcugccauucaacgacggcguguacuucgccagcaccgagaagucaaacaucauccggggcuggaucuucggcaccacccuggacagcaagacacagagccugcugaucgugaacaacgccaccaacgcugugaucaaggugugcgaguuucaguucugcaacgaccccuuccugggcguguaccacaagaacaacaagagcuggauggagagcgaguuccggguguacagcagcgccaacaauugcaccuucgaguacgugagccagcccuuccugauggaccucgagggcaagcagggcaacuucaagaaccugcgggaguucgucuucaagaacaucgauggcuacuucaagaucuacagcaagcacacccccaucaaccuggugcgggaccugccccagggauucagcgcccuggagccccugguggaccugccuaucggcaucaacaucaccagguuccagacccuguaccggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuucgagcgggacaucagcaccgagaucuaccaggccggcaacaccccaugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggccccaaaaagagcaccaaccuggugaagaacaagugcgugaauuucaacuucaacggccugaccggcaccggcgugcugaccgagagcaacaagaaguuccugccuuuccagcaguucggccgggauaucgccgacaccaccgacgcagugcgggacccccagacccuggagauccuggacaucacccccugcagcuucggcggcgugagcgugaucaccccaggcacaaacaccagcaaccagguggccguccuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagccugggcgccgagaacagcguggccuacagcaacaacagcaucgcgauccccaccaacuucaccaucagcgugaccaccgagauacugcccgugagcaugaccaagaccagcguggacuguaccauguacaucugcggcgacagcaccgagugcagcaacuuacugcugcaguacggcagcuucugcacccagcugaaccgggcccugaccggcaucgccguggagcaggacaagaacacccaagagguguucgcccaggugaagcagaucuacaagacuccucccaucaaggacuucggcggcuucaacuucagccagauccugcccgacccaagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccugcagauccccuucgccaugcagauggccuaccgguucaacggcaucggcgugacccagaacgugcuuuacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcucagugcugaacgacauccugagcaggcuggacccacccgaggccgaggugcagaucgaccggcugaucaccggccggcugcagagccugcagaccuacgugacccagcagcugauccgggccgccgagauccgggccagcgccaaccuggcagccauuaagaugagcgagugcgugcugggccagagcaagcggguggacuuuugcggcaagggcuaccaccugaugagcuucccccagagcgcuccccacggcgugguguuccugcacgugaccuacgugcccgcccaggagaagaacuucacaaccgcccccgccaucugccacgacggcaaggcccacuucccccgggagggaguguucgucagcaacggcacccacugguucgugacccagcggaacuucuacgagccccagaucaucaccacccacaacaccuucgugagcggcaacugcgacguggugaucggcaucgugaacaacaccguguacgacccccugcagccugagcucgacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27609 - RNA, 4073 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgugaccagcaaccacaagaacaacaagagcuggauggagagcgaguuccgggucuacagcagcgcuaauaacugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcauugugcgguuccccaacaucaccaaccugugucccuucggcgagguguucaacgccaccaaguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcuccaacguguuccagacccgggccggcugccugaucggcgccgagcacgugaacaacagcuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcagaacguggugaaccagaacgcucaggcccugaacacccuggugaagcagcugagcagcaauuucggcgccaucucaagcgugcugaacgacauccugagccggcuggacccacccgaggccgaggugcagaucgacaggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27610 - RNA, 4079 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcggaccgacagggaccugccccagggauucagcgcccuggagccucugguggaccugcccaucggcaucaacaucacccgguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagacuagcaacuuccgggugcagcccaccgagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggcaagaccggcaagaucgccgacuacaacuacaagcugcccgacgacuucaccggcugcgugaucgccuggaacagcaacaaccuggacagcaaggugggcggcaacuacaaguaccuguaccggcuguuccguaagagcaaccugaagccauucgagcgggauaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggacaucgccgacaccaccgacgcagugcgggacccccagacccuggagauccuggacaucaccccaugcagcuucggcggcgugagcgucaucacacccggcaccaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaucaacuucaccauaagcgugaccaccgagauccugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaggagguguucgcccaagugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggggacaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagccggcuggaucccccagaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27611 - RNA, 4070 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacacaagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcauggccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgcugcccgggaccugaucugcgcccagaaguucaacggccugacugugcugccuccccugcugaccgacgagaugaucgcccaguacaccagcgcccugcuugccggcaccaucaccagcggcuggaccuucggcgcaggcgccgcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcucugggcaagcugcaggacguggugaaccagaacgcccaggcccugaacacccuggugaagcagcugagcagcaacuucggcgccaucagcucagugcugaaugacauccugagcaggcuggacccacccgaggccgaggugcagaucgaccggcugaucaccggccggcugcagagccugcagaccuacgugacccagcagcugauccgggccgccgagauccgggccagcgcaaaccuggccgccaccaagaugagcgagugcgugcugggccagagcaagcggguggacuuuugcggcaagggcuaccaccugaugagcuucccccagagcgcuccccacggcgugguguuccuccacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27612 - RNA, 4070 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacccacccgaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccggaagggaguguucgugagcaacggcaccuacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcuucgugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27613 - RNA, 4064 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguucgacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccuggugguccacaagaacaacaagagcuggauggagagcgaguuccggguguacagcagcgcuaacaauugcaccuucgaguacgugagccagcccuuccugauggaucucgagggcaagcagggcaacuucaagaaccugcgggaguucguguucaagaacaucgacggcuacuucaagaucuacagcaagcacacccccaucaaccuggugcggggccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugccgagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgcagacaccaccgacgccgugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgcugaguacgugaacaacuccuacgagugcgacauccccaucggcgccagcaucugcgccagcuaccagacccagaccaacagcccccggcgggcccggagcguggccagccagagcaucaucgccuacaccaugagcuuaggcgccgagaacagcguggcguacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgcugcccgggaccugaucugcgcccagaaguucaacgggcugaccgugcugcccccucugcugaccgacgagaugaucgcccaguacaccagcgcccugcuugccggcaccaucaccagcggcuggaccuucggcgcaggcgccgcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcucugggcaagcugagggacguggugaaccagaacgcccaggcccugaacacccuggugaagcagcugagcagcaacuucggcgccaucucaagcgugcugaaugacauccugagccggcuggaucccccagaggccgaggugcagaucgaccggcugaucaccggccggcugcagagccugcagaccuacgugacccagcagcugauccgggccgccgagauccgggccagcgcaaaccuggccgccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcuggacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27614 - RNA, 4067 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacacaagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggcgacaucgccgcuagggaccugaucugcgcccagaaguucaacgggcugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugaccuacguccccgcccaggagaagaacuucacaaccgcccccgccauuugccacgacggcaaggcccacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27615 - RNA, 4064 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuccuggugcugcugccccuggugagcagccagugcgugaaccugcggacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgugcacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugagggaccugccccagggauucagcgcccuggagccucugguggaccugcccaucggcaucaacaucacccgguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacaccagcaaccagguggccgugcuguaccagggagugaacugcacagaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagaggagcuucaucgaggaccugcuguucaacaaggugacccuggccgacgccggcuucaucaagcaguacggcgacugccugggggauaucgccgcucgggaccugaucugcgcccagaaguucaacggccugacugugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27616 - RNA, 4061 nt, Artificial Sequence
  SARS-CoV-2/Wuhan/WIV05/2019__EPI_ISL_402128 spike protein mRNA gc mod (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27617 - RNA, 4061 nt, Artificial Sequence
  SARS-CoV-2/Wuhan/WIV05/2019__EPI_ISL_402128 spike protein mRNA gc mod (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27618 - RNA, 4061 nt, Artificial Sequence
  SARS-CoV-2/Wuhan/WIV05/2019__EPI_ISL_402128 spike protein mRNA gc mod (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccgcgaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacacacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27619 - RNA, 4061 nt, Artificial Sequence
  SARS-CoV-2/Wuhan/WIV05/2019__EPI_ISL_402128 spike protein mRNA gc mod (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacacacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27620 - RNA, 4070 nt, Artificial Sequence
  SARS-CoV-2/Wuhan/WIV05/2019__EPI_ISL_402128 spike protein mRNA gc mod (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27621 - RNA, 4070 nt, Artificial Sequence
  SARS-CoV-2/Wuhan/WIV05/2019__EPI_ISL_402128 spike protein mRNA gc mod (1-1273)(K986P_V987P_E484K_D614G_V1176F)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27622 - RNA, 4070 nt, Artificial Sequence
  SARS-CoV-2/Wuhan/WIV05/2019__EPI_ISL_402128 spike protein mRNA gc mod (1-1273)(K986P_V987P_L452R_D614G_P681R)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27623 - RNA, 4070 nt, Artificial Sequence
  SARS-CoV-2/Wuhan/WIV05/2019__EPI_ISL_402128 spike protein mRNA gc mod (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggaugaagagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcgugcagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucacgagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27624 - RNA, 4064 nt, Artificial Sequence
  SARS-CoV-2/Wuhan/WIV05/2019__EPI_ISL_402128 spike protein mRNA gc mod (1-1273)(K986P_V987P_T19R_F157del_R158del_L452R_T478K_D614G_P681R _D950N)
aggagagucccgcagucggcguccagcggcucugcuuguucgugugugugucguugcaggccuuauucaagcuuaccauguucguguuucuggugcugcugccccugguguccagccagugugugaaccugcgcaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27625 - RNA, 4049 nt, Artificial Sequence
  SARS-CoV-2/Wuhan/WIV05/2019__EPI_ISL_402128 spike protein mRNA gc mod (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaaugugaucaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccaguaccggcuguuccggaaguccaaucugaagcccuucgagcgggacaucagcaccgaaaucuaucaggccggcagcaccccuugcaacggcguggaaggcuucaacugcuacagcccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugaacgugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27626 - RNA, 4064 nt, Artificial Sequence
  SARS-CoV-2/Wuhan/WIV05/2019__EPI_ISL_402128 spike protein mRNA gc mod (1-1273)(K986P_V987P_H69del_V70del_N439K_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27627 - RNA, 4070 nt, Artificial Sequence
  SARS-CoV-2/Wuhan/WIV05/2019__EPI_ISL_402128 spike protein mRNA gc mod (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguuuuucgugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27628 - RNA, 4070 nt, Artificial Sequence
  SARS-CoV-2/Wuhan/WIV05/2019__EPI_ISL_402128 spike protein mRNA gc mod (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguuuuucgugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccgcgcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27629 - RNA, 4070 nt, Artificial Sequence
  SARS-CoV-2/Wuhan/WIV05/2019__EPI_ISL_402128 spike protein mRNA gc mod (1-1273)(K986P_V987P_F157L_V367F_Q613H_P681R)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagcugcggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccuuccuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccacgacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27630 - RNA, 4070 nt, Artificial Sequence
  SARS-CoV-2/Wuhan/WIV05/2019__EPI_ISL_402128 spike protein mRNA gc mod (1-1273)(K986P_V987P_S254F_D614G_P681R_G769V)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauuucagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagugaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27631 - RNA, 4052 nt, Artificial Sequence
  SARS-CoV-2/Wuhan/WIV05/2019__EPI_ISL_402128 spike protein mRNA gc mod (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuagcgccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacgccgucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacuguacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27632 - RNA, 4073 nt, Artificial Sequence
  SARS-CoV-2/Wuhan/WIV05/2019__EPI_ISL_402128 spike protein mRNA gc mod (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucaccagcaaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccaaguucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27633 - RNA, 4079 nt, Artificial Sequence
  SARS-CoV-2/Wuhan/WIV05/2019__EPI_ISL_402128 spike protein mRNA gc mod (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggaccgaccgcgaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggaaagacaggcaagaucgccgacuacaacuacaagcugcccgacgacuucaccggcugugugauugccuggaacagcaacaaccuggacuccaaagucggcggcaacuacaaguaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27634 - RNA, 4070 nt, Artificial Sequence
  SARS-CoV-2/Wuhan/WIV05/2019__EPI_ISL_402128 spike protein mRNA gc mod (1-1273)(K986P_V987P_T478K_D614G_P681H_T732A)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccauggccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27635 - RNA, 4070 nt, Artificial Sequence
  SARS-CoV-2/Wuhan/WIV05/2019__EPI_ISL_402128 spike protein mRNA gc mod (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagaaagggcguguucguguccaacggcaccuacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27636 - RNA, 4064 nt, Artificial Sequence
  SARS-CoV-2/Wuhan/WIV05/2019__EPI_ISL_402128 spike protein mRNA gc mod (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguucgacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccuggugguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgccgaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuagcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcgcgacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcuggacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27637 - RNA, 4067 nt, Artificial Sequence
  SARS-CoV-2/Wuhan/WIV05/2019__EPI_ISL_402128 spike protein mRNA gc mod (1-1273)(K986P_V987P_Y144del_L452R_T478K_P681R)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27638 - RNA, 4064 nt, Artificial Sequence
  SARS-CoV-2/Wuhan/WIV05/2019__EPI_ISL_402128 spike protein mRNA gc mod (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuucuggugcugcugccccugguguccagccagugugugaaccugcgcaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27639 - RNA, 4061 nt, Artificial Sequence
  SARS-CoV-2/Wuhan/WIV05/2019__EPI_ISL_402128 spike protein mRNA gc mod (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27640 - RNA, 4061 nt, Artificial Sequence
  SARS-CoV-2/Wuhan/WIV05/2019__EPI_ISL_402128 spike protein mRNA gc mod (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27641 - RNA, 4061 nt, Artificial Sequence
  SARS-CoV-2/Wuhan/WIV05/2019__EPI_ISL_402128 spike protein mRNA gc mod (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccgcgaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacacacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27642 - RNA, 4061 nt, Artificial Sequence
  SARS-CoV-2/Wuhan/WIV05/2019__EPI_ISL_402128 spike protein mRNA gc mod (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacacacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27643 - RNA, 4070 nt, Artificial Sequence
  SARS-CoV-2/Wuhan/WIV05/2019__EPI_ISL_402128 spike protein mRNA gc mod (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27644 - RNA, 4070 nt, Artificial Sequence
  SARS-CoV-2/Wuhan/WIV05/2019__EPI_ISL_402128 spike protein mRNA gc mod (1-1273)(K986P_V987P_E484K_D614G_V1176F)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27645 - RNA, 4070 nt, Artificial Sequence
  SARS-CoV-2/Wuhan/WIV05/2019__EPI_ISL_402128 spike protein mRNA gc mod (1-1273)(K986P_V987P_L452R_D614G_P681R)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27646 - RNA, 4070 nt, Artificial Sequence
  SARS-CoV-2/Wuhan/WIV05/2019__EPI_ISL_402128 spike protein mRNA gc mod (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggaugaagagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcgugcagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucacgagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27647 - RNA, 4064 nt, Artificial Sequence
  SARS-CoV-2/Wuhan/WIV05/2019__EPI_ISL_402128 spike protein mRNA gc mod (1-1273)(K986P_V987P_T19R_F157del_R158del_L452R_T478K_D614G_P681R _D950N)
aggagagucccgcagucggcguccagcggcucugcuuguucgugugugugucguugcaggccuuauucaagcuuaccauguucguguuccuggugcugcugccucugguguccagccagugugugaaccugcgcaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27648 - RNA, 4049 nt, Artificial Sequence
  SARS-CoV-2/Wuhan/WIV05/2019__EPI_ISL_402128 spike protein mRNA gc mod (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaaugugaucaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccaguaccggcuguuccggaaguccaaucugaagcccuucgagcgggacaucuccaccgagaucuaucaggccggcagcaccccuuguaacggcguggaaggcuucaacugcuacagcccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugaacgugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27649 - RNA, 4064 nt, Artificial Sequence
  SARS-CoV-2/Wuhan/WIV05/2019__EPI_ISL_402128 spike protein mRNA gc mod (1-1273)(K986P_V987P_H69del_V70del_N439K_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27650 - RNA, 4070 nt, Artificial Sequence
  SARS-CoV-2/Wuhan/WIV05/2019__EPI_ISL_402128 spike protein mRNA gc mod (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguucuucgugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27651 - RNA, 4070 nt, Artificial Sequence
  SARS-CoV-2/Wuhan/WIV05/2019__EPI_ISL_402128 spike protein mRNA gc mod (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguucuucgugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccgcgcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27652 - RNA, 4070 nt, Artificial Sequence
  SARS-CoV-2/Wuhan/WIV05/2019__EPI_ISL_402128 spike protein mRNA gc mod (1-1273)(K986P_V987P_F157L_V367F_Q613H_P681R)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagcugcggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccuuccuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccacgacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27653 - RNA, 4070 nt, Artificial Sequence
  SARS-CoV-2/Wuhan/WIV05/2019__EPI_ISL_402128 spike protein mRNA gc mod (1-1273)(K986P_V987P_S254F_D614G_P681R_G769V)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauuucagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagugaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27654 - RNA, 4052 nt, Artificial Sequence
  SARS-CoV-2/Wuhan/WIV05/2019__EPI_ISL_402128 spike protein mRNA gc mod (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuagcgccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacgccgucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacuguacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27655 - RNA, 4073 nt, Artificial Sequence
  SARS-CoV-2/Wuhan/WIV05/2019__EPI_ISL_402128 spike protein mRNA gc mod (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucaccagcaaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccaaguucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27656 - RNA, 4079 nt, Artificial Sequence
  SARS-CoV-2/Wuhan/WIV05/2019__EPI_ISL_402128 spike protein mRNA gc mod (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggaccgaccgcgaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggaaagacaggcaagaucgccgacuacaacuacaagcugcccgacgacuucaccggcugugugauugccuggaacagcaacaaccuggacuccaaagucggcggcaacuacaaguaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27657 - RNA, 4070 nt, Artificial Sequence
  SARS-CoV-2/Wuhan/WIV05/2019__EPI_ISL_402128 spike protein mRNA gc mod (1-1273)(K986P_V987P_T478K_D614G_P681H_T732A)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccauggccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27658 - RNA, 4070 nt, Artificial Sequence
  SARS-CoV-2/Wuhan/WIV05/2019__EPI_ISL_402128 spike protein mRNA gc mod (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagaaagggcguguucguguccaacggcaccuacugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27659 - RNA, 4064 nt, Artificial Sequence
  SARS-CoV-2/Wuhan/WIV05/2019__EPI_ISL_402128 spike protein mRNA gc mod (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguucgacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccuggugguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgccgaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuagcaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcgcgacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcuggacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27660 - RNA, 4067 nt, Artificial Sequence
  SARS-CoV-2/Wuhan/WIV05/2019__EPI_ISL_402128 spike protein mRNA gc mod (1-1273)(K986P_V987P_Y144del_L452R_T478K_P681R)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27661 - RNA, 4064 nt, Artificial Sequence
  SARS-CoV-2/Wuhan/WIV05/2019__EPI_ISL_402128 spike protein mRNA gc mod (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuccuggugcugcugccucugguguccagccagugugugaaccugcgcaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27662 - RNA, 4009 nt, Artificial Sequence
  SARS-CoV-2/Wuhan/WIV05/2019__EPI_ISL_402128 spike protein mRNA gc (1-1273)(K986P_V987P) R10503
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27663 - RNA, 4009 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27664 - RNA, 4009 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27665 - RNA, 4009 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27666 - RNA, 4009 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27667 - RNA, 4009 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27668 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27669 - RNA, 4009 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27670 - RNA, 4009 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27671 - RNA, 4009 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27672 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27673 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27674 - RNA, 4000 nt, Artificial Sequence
  SARS-CoV-2/Wuhan/WIV05/2019__EPI_ISL_402128 spike protein mRNA gc (1-1273)(K986P_V987P_H69del_V70del_Y144del_N501Y_A570D_D614G_P681 H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27675 - RNA, 4009 nt, Artificial Sequence
  SARS-CoV-2/Wuhan/WIV05/2019__EPI_ISL_402128 spike protein mRNA gc (1-1273)(K986P_V987P_K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27676 - RNA, 4000 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_R246 I_K417N_E484K_N501Y_D614G_A701V)
aggagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27677 - RNA, 4009 nt, Artificial Sequence
  SARS-CoV-2/Wuhan/WIV05/2019__EPI_ISL_402128 spike protein mRNA gc (1-1273)(K986P_V987P_E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27678 - RNA, 4009 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I)
aggagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27679 - RNA, 4009 nt, Artificial Sequence
  SARS-CoV-2/Wuhan/WIV05/2019__EPI_ISL_402128 spike protein mRNA gc (1-1273)(K986P_V987P_S13I_W152C_L452R_D614G)
aggagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27680 - RNA, 4000 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27681 - RNA, 4000 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacagguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27682 - RNA, 4000 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccgcgaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27683 - RNA, 4000 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27684 - RNA, 4009 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27685 - RNA, 4009 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27686 - RNA, 4009 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27687 - RNA, 4009 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27688 - RNA, 4003 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagaaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27689 - RNA, 3988 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcacgacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccaguaccgccuguuccgcaagagcaaccucaagcccuucgagcgggacaucuccaccgagaucuaccaggccggcagcacccccugcaacgggguggagggcuucaacugcuacagcccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27690 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27691 - RNA, 4009 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagaaagcuuaccauguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27692 - RNA, 4009 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagaaagcuuaccauguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccgcgcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27693 - RNA, 4009 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccacgacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27694 - RNA, 4009 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacuucagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggugaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27695 - RNA, 3991 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagaaagcuuaccauguucguguuccugguccuccugccccuggugagcucccagugcgugaaccucaccacccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacgccgucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccucuaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27696 - RNA, 4012 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugaccagcaaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccaaguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27697 - RNA, 4018 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggaccgaccgcgaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggcaagaccgggaagaucgccgacuacaacuacaagcugccggacgacuucacgggcugcgugaucgcguggaacagcaacaaccucgacuccaaggucgggggcaacuacaaguaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27698 - RNA, 4009 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcauggccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27699 - RNA, 4009 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcaagggcguguucguguccaacgggaccuacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27700 - RNA, 4003 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguucgacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucguggugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccagcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcgcgacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccuggacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27701 - RNA, 4006 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27702 - RNA, 4003 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagaaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27703 - RNA, 4009 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgcgccccacggcgugguguuccuccacgucacguacgugcccgcccaggagaagaacuucaccaccgccccggccaucugccacgacgggaaggcccacuucccccgcgagggcgucuucguguccaacgggacccacugguucgugacgcagcggaacuucuacgagccccagaucaucaccaccgacaacaccuucgucagcggcaacugcgacguggugaucggcaucgucaacaacacgguguacgacccccugcagccggagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggcccugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagccggugcugaagggggucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27704 - RNA, 4009 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27705 - RNA, 4009 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcgcacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgccaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27706 - RNA, 4009 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27707 - RNA, 4009 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacccgcccgaggccgagguccagaucgaccggcugaucaccggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucacguacgugcccgcccaggagaagaacuucaccaccgccccggccaucugccacgacggcaaggcccacuucccccgcgagggggucuucgugagcaacggcacccacugguucgugacgcagcggaacuucuacgagccccagaucaucaccaccgacaacaccuucgucuccggcaacugcgacguggugaucgggaucgucaacaacacgguguacgacccccugcagccggagcuggacagcuucaaggaggagcucgacaaguacuucaagaaccacaccucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27708 - RNA, 4009 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27709 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27710 - RNA, 4009 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27711 - RNA, 4009 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcccacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27712 - RNA, 4009 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27713 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacccgcccgaggccgaggugcagaucgaccggcugaucaccggccgccuccagucccugcagaccuacgugacccagcagcugauccgggccgcggagauccgcgccagcgccaaccucgccgccaccaagaugagcgagugcguccugggccaguccaagcggguggacuucugcgggaagggcuaccaccugaugagcuucccccaguccgcgccccacgggguggucuuccuccacgugacguacguccccgcccaggagaagaacuucaccaccgccccggccaucugccacgacggcaaggcgcacuucccccgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagccggagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27714 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27715 - RNA, 4000 nt, Artificial Sequence
  SARS-CoV-2/Wuhan/WIV05/2019__EPI_ISL_402128 spike protein mRNA gc (1-1273)(K986P_V987P_H69del_V70del_Y144del_N501Y_A570D_D614G_P681 H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27716 - RNA, 4009 nt, Artificial Sequence
  SARS-CoV-2/Wuhan/WIV05/2019__EPI_ISL_402128 spike protein mRNA gc (1-1273)(K986P_V987P_K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27717 - RNA, 4000 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_R246 I_K417N_E484K_N501Y_D614G_A701V)
aggagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacccgcccgaggccgaggugcagaucgaccgccugaucaccggccggcuccagagccugcagaccuacgugacccagcagcugauccgcgccgcggagauccgggccagcgccaaccucgccgccaccaagauguccgagugcguccuggggcagagcaagcgcguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgggagggcguguucguguccaacggcacccacugguucgucacgcagcgcaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27718 - RNA, 4009 nt, Artificial Sequence
  SARS-CoV-2/Wuhan/WIV05/2019__EPI_ISL_402128 spike protein mRNA gc (1-1273)(K986P_V987P_E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27719 - RNA, 4009 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I)
aggagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcgucgugaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27720 - RNA, 4009 nt, Artificial Sequence
  SARS-CoV-2/Wuhan/WIV05/2019__EPI_ISL_402128 spike protein mRNA gc (1-1273)(K986P_V987P_S13I_W152C_L452R_D614G)
aggagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaccaagaugagcgagugcgugcucggccaguccaagcgcgucgacuucugcgggaagggcuaccaccugaugagcuucccccaguccgcgccccacggggugguguuccugcacgucacguacgugcccgcccaggagaagaacuucaccaccgccccggccaucugccacgacggcaaggcccacuucccccgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccuccagccggagcuggacagcuucaaggaggagcuggacaaguacuucaagaaccacaccucccccgacguggaccucggcgacaucagcgggaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggcuucaucgccgggcugaucgcgaucgucauggugaccaucaugcugugcugcaugaccuccugcugcagcugccucaagggcugcugcuccugcgggagcugcugcaaguucgacgaggacgacuccgagccggugcugaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27721 - RNA, 4000 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27722 - RNA, 4000 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcaccgguccuaccucacgccgggcgacagcagcuccggcuggaccgcgggggccgccgccuacuacgugggcuaccugcagccccgcaccuuccugcucaaguacaacgagaacgggaccaucacggacgcggucgacugcgcccuggacccccugagcgagaccaagugcacccucaaguccuucaccguggagaagggcaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggggucagccccaccaagcucaacgaccugugcuucaccaacguguacgccgacuccuucgugauccgcggcgacgagguccggcagaucgcccccgggcagaccggcaacaucgccgacuacaacuacaagcugccggacgacuucacggggugcgugaucgcguggaacagcaacaaccucgacuccaaggugggcggcaacuacaacuaccuguaccgccuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccggguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgcgacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggcgccgggaucugcgccagcuaccagacgcagaccaacuccccgcggcgcgcccggagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgcgcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgguccuucaucgaggaccuccuguucaacaaggugacccuggccgacgccggguucaucaagcaguacggcgacugccucggggacaucgccgcgcgcgaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgguucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccuggggcagagcaagcggguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgcgagggcguguucguguccaacggcacccacugguucgucacgcagcggaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27723 - RNA, 4000 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccgggaccucuuccugcccuucuucagcaacgucacgugguuccacgugaucuccgggaccaacggcaccaagcgcuucgacaacccggugcugcccuucaacgacggggucuacuucgccagcaccgagaaguccaacaucauccggggcuggaucuucgggacgacccucgacagcaagacccagucccugcugaucgugaacaacgcgaccaacguggucaucaaggugugcgaguuccaguucugcaacgaccccuuccucggcguguaccacaagaacaacaagagcuggauggaguccgaguuccgcgucuacagcuccgccaacaacugcacguucgaguacgugagccagcccuuccugauggaccuggagggcaagcaggggaacuucaagaaccuccgggaguucguguucaagaacaucgacggcuacuucaagaucuacuccaagcacaccccgaucaaccugguccgcgaccugccccagggguucagcgcccucgagccccugguggaccugcccaucggcaucaacaucacccgguuccagacccuccuggcccugcaccgcuccuaccucacgccgggggacagcagcuccggcuggaccgccggcgcggccgccuacuacgugggguaccugcagccccggaccuuccugcucaaguacaacgagaacggcaccaucacggacgccgucgacugcgcgcuggacccccugagcgagaccaagugcacccucaaguccuucaccguggagaaggggaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccggcuguuccgcaagagcaaccucaagcccuucgagcgggacaucuccaccgagaucuaccaggcgggcagcacccccugcaacggggugaagggcuucaacugcuacuucccccugcaguccuacggguuccagccgaccaacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgggacccccagacccuggagauccucgacaucacccccugcagcuucggcgggguguccgugaucacgccgggcaccaacaccagcaaccaggucgcggugcuguaccagggcgugaacugcaccgagguccccguggccauccacgccgaccagcugacgcccaccuggcgcguguacuccaccgggagcaacgucuuccagacccgggccggcugccucaucggggccgagcacgugaacaacuccuacgagugcgacauccccaucggcgcgggcaucugcgccagcuaccagacgcacaccaacuccccgcgccgggcccgcagcguggccucccagagcaucaucgcguacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcccugacgggcaucgcgguggagcaggacaagaacacccaggagguguucgcccaggucaagcagaucuacaagacgcccccgaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccucggcgacaucgccgcgcgggaccugaucugcgcccagaaguucaacgggcugaccgugcucccgccccugcugaccgacgagaugaucgcccaguacaccagcgcccuccuggccggcaccaucacguccggguggacccugggcgcgggcgccgcccuccagauccccuucgccaugcagauggcguaccgcuucaacgggaucggcgucacccagaacgugcuguacgagaaccagaagcugaucgccaaccaguucaacagcgccaucgggaagauccaggacucccucagcuccaccgccagcgcccugggcaagcugcaggacguggucaaccagaacgcgcaggcccucaacacgcuggugaagcagcuguccagcaacuucggggccaucuccagcgugcucaacgacauccugucccggcuggacccgcccgaggccgagguccagaucgaccgccucaucaccggccggcugcagagccugcagaccuacgugacccagcagcucauccgcgccgcggagauccgggccagcgccaaccuggccgccaccaagauguccgagugcgugcugggccagagcaagcgcgucgacuucugcgggaagggcuaccaccucauguccuucccccagagcgcgccccacggggugguguuccugcacgucacguacgugcccgcccaggagaagaacuucaccaccgccccggccaucugccacgacggcaaggcgcacuucccccgggagggggucuucguguccaacggcacccacugguucgugacgcagcgcaacuucuacgagccccagaucaucaccaccgacaacaccuucgucagcggcaacugcgacguggugaucgggaucgucaacaacacgguguacgacccccugcagccggagcucgacuccuucaaggaggagcuggacaaguacuucaagaaccacaccagccccgacguggaccugggcgacaucuccgggaucaacgccagcgucgugaacauccagaaggagaucgaccggcucaacgagguggccaagaaccugaacgagucccugaucgaccuccaggagcugggcaaguacgagcaguacaucaaguggcccugguacaucuggcugggcuucaucgccgggcucaucgccaucgucauggugaccaucaugcugugcugcaugaccagcugcugcuccugccugaagggcugcugcagcugcggguccugcugcaaguucgacgaggacgacagcgagccggugcucaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27724 - RNA, 4000 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgccagcaccgagaaguccaacaucauccgcggcuggaucuucgggacgacccucgacagcaagacccagucccugcugaucgugaacaacgcgaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcgggguguccgugaucacgccgggcaccaacaccagcaaccaggucgcggugcuguaccagggcgugaacugcaccgagguccccguggccauccacgccgaccagcugacgcccaccuggcggguguacuccaccgggagcaacgucuuccagacccgcgccggcugccucaucggggccgagcacgugaacaacuccuacgagugcgacauccccaucggcgcgggcaucugcgccagcuaccagacgcacaccaacuccccgcggcgcgcccggagcguggccucccagagcaucaucgcguacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcccugacgggcaucgcgguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccgugcucccgccccugcugaccgacgagaugaucgcccaguacaccagcgcccuccuggccggcaccaucacguccggguggacccugggcgcgggcgccgcccuccagauccccuucgccaugcagauggcguaccgguucaacgggaucggcgucacccagaacgugcuguacgagaaccagaagcugaucgccaaccaguucaacagcgccaucgggaagauccaggacucccucagcuccaccgccagcgcccugggcaagcugcaggacguggucaaccagaacgcgcaggcccucaacacgcuggugaagcagcuguccagcaacuucggggccaucuccagcgugcucaacgacauccugucccgccuggacccgcccgaggccgagguccagaucgaccggcucaucaccggccgccugcagagccugcagaccuacgugacccagcagcucauccgggccgcggagauccgcgccagcgccaaccuggccgccaccaagauguccgagugcgugcugggccagagcaagcgggucgacuucugcgggaagggcuaccaccucauguccuucccccagagcgcgccccacggggugguguuccugcacgucacguacgugcccgcccaggagaagaacuucaccaccgccccggccaucugccacgacggcaaggcgcacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcucgacuccuucaaggaggagcuggacaaguacuucaagaaccacaccagccccgacguggaccugggcgacaucuccgggaucaacgccagcgucgugaacauccagaaggagaucgaccgccucaacgagguggccaagaaccugaacgagucccugaucgaccuccaggagcugggcaaguacgagcaguacaucaaguggcccugguacaucuggcugggcuucaucgccgggcucaucgccaucgucauggugaccaucaugcugugcugcaugaccagcugcugcuccugccugaagggcugcugcagcugcggguccugcugcaaguucgacgaggacgacagcgagccggugcucaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27725 - RNA, 4009 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcuucgucaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgugauggucaccaucaugcugugcugcaugaccagcugcugcuccugccucaagggcugcugcagcugcggguccugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27726 - RNA, 4009 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcuucgucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27727 - RNA, 4009 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcacccccugcaacgggguggagggcuucaacugcuacuucccccuccaguccuacggguuccagccgaccaacggcgugggguaccagcccuaccgcguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcgcguguacuccaccgggagcaacgucuuccagacccgggccggcugccugaucggggcggagcacgugaacaacuccuacgagugcgacauccccaucggcgccggcaucugcgccagcuaccagacgcagaccaacucccgccggcgcgcccggagcguggcgucccagagcaucaucgccuacaccaugucccucggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacccgcccgaggccgagguccagaucgaccggcugaucaccggccgccugcagagccuccagaccuacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucacguacgugcccgcccaggagaagaacuucaccaccgcccccgccaucugccacgacggcaaggcccacuucccgcgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27728 - RNA, 4009 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcacccccugcaacggggugcagggcuucaacugcuacuucccccuccaguccuacggguuccagccgaccaacggcgugggguaccagcccuaccgcguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcgcguguacuccaccgggagcaacgucuuccagacccgggccggcugccugaucggggcggagcacgugaacaacuccuacgagugcgacauccccaucggcgccggcaucugcgccagcuaccagacgcagaccaacucccgccggcgcgcccggagcguggcgucccagagcaucaucgccuacaccaugucccucggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacccgcccgaggccgagguccagaucgaccggcugaucaccggccgccugcagagccuccagaccuacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucacguacgugcccgcccacgagaagaacuucaccaccgcccccgccaucugccacgacggcaaggcccacuucccgcgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27729 - RNA, 4003 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagaaagcuuaccauguucguguuccugguccuccugccccuggugagcucccagugcgugaaccuccgcacccggacccagcugccgcccgccuacacgaacagcuucacccgcggcgucuacuaccccgacaagguguuccgguccagcgugcugcacuccacccaggaccucuuccugcccuucuucagcaacgucaccugguuccacgccauccacguguccgggacgaacggcaccaagcgcuucgacaacccggugcugcccuucaacgacggggucuacuucgcgagcaccgagaaguccaacaucauccggggcuggaucuucgggaccacgcucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcaccuucgaguacgugagccagcccuuccugauggaccuggagggcaagcaggggaacuucaagaaccuccgcgaguucguguucaagaacaucgacggcuacuucaagaucuacuccaagcacacgccgaucaaccugguccgggaccugccccagggguucagcgcccucgagccccugguggaccugcccaucggcaucaacaucacccgcuuccagacccuccuggcccugcaccgguccuaccucaccccgggggacagcagcuccggcuggacggcgggcgccgccgccuacuacgugggguaccugcagccccgcaccuuccugcucaaguacaacgagaacggcaccaucaccgacgcggucgacugcgcccuggacccccugagcgagacgaagugcacccucaaguccuucaccguggagaaggggaucuaccagaccagcaacuuccgggugcagcccacggaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccaccuucaagugcuacggcgucagccccacgaagcucaacgaccugugcuucaccaacguguacgccgacuccuucgugauccgcggggacgagguccggcagaucgcccccggccagaccgggaagaucgccgacuacaacuacaagcugccggacgacuucaccggcugcgugaucgcguggaacagcaacaaccucgacuccaaggucgggggcaacuacaacuaccgcuaccggcuguuccgcaagagcaaccugaagcccuucgagcgggacaucuccacggagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccaccaaccuggucaagaacaagugcgugaacuucaacuucaacggccugacggggaccggcgugcucaccgagagcaacaagaaguuccugccguuccagcaguucgggcgcgacaucgccgacaccaccgacgcgguccgggacccccagacgcuggagauccuggacaucacccccugcagcuucggcgggguguccgugaucaccccgggcaccaacacgagcaaccaggucgccgugcucuaccagggcgugaacugcaccgagguccccguggccauccacgccgaccagcugacccccaccuggcgcguguacuccacggggagcaacgucuuccagacccgggccggcugccugaucggggcggagcacgugaacaacuccuacgagugcgacauccccaucggcgccggcaucugcgccagcuaccagacccagaccaacucccgccggcgcgcccggagcguggcgucccagagcaucaucgccuacacgaugucccucggggccgagaacagcgucgccuacuccaacaacagcaucgccaucccgaccaacuucaccaucuccgugaccacggagauccugcccgugagcaugaccaagaccagcgucgacugcaccauguacaucugcggcgacuccacggagugcagcaaccugcuccugcaguacggguccuucugcacccagcugaaccgcgcgcucaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugaccgugcugcccccgcuccugaccgacgagaugaucgcccaguacacgagcgcccugcucgcgggcaccaucaccuccggguggaccuucggcgccggcgccgcccugcagauccccuucgcgaugcagauggccuaccgguucaacgggaucggcgucacgcagaacgugcuguacgagaaccagaagcucaucgccaaccaguucaacagcgccaucgggaagauccaggacucccugagcuccaccgccagcgcgcugggcaagcuccagaacguggucaaccagaacgcccaggcccugaacacccuggugaagcagcucuccagcaacuucggggccaucuccagcgugcugaacgacauccugucccgccucgacccgcccgaggccgagguccagaucgaccggcugaucaccggccgccugcagagccuccagacguacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucaccuacgugcccgcccaggagaagaacuucaccacggcccccgccaucugccacgacggcaaggcccacuucccgcgcgagggggucuucguguccaacggcacccacugguucgugacccagcggaacuucuacgagccccagaucaucaccacggacaacaccuucgucagcggcaacugcgacguggugaucgggaucgucaacaacaccguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugacgaucaugcugugcugcaugaccagcugcugcuccugccucaagggcugcugcagcugcggguccugcugcaaguucgacgaggacgacagcgagcccgugcugaagggcgucaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27730 - RNA, 3988 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccgguccugcccuucaacgacggcguguacuucgcgagcaccgagaaguccaacaucauccgcggguggaucuucggcaccacgcucgacagcaagacccagucccugcugaucgugaacaacgccaccaacgucgugaucaaggugugcgaguuccaguucugcaacgaccccuuccucggggucuacuaccacaagaacaacaagagcuggauggaguccgaguuccggguguacagcuccgccaacaacugcaccuucgaguacgugagccagcccuuccugauggaccuggagggcaagcagggcaacuucaagaaccuccgcgaguucgucuucaagaacaucgacggguacuucaagaucuacuccaagcacacgccgaucaaccuggugcgggaccugccccagggcuucagcgcccucgagccccugguggaccugcccaucgggaucaacaucacccgcuuccagacccuccuggcccugcacgacuccagcagcggcuggaccgcgggggccgccgccuacuacgucggcuaccuccagccgcggacguuccugcugaaguacaacgagaacggcaccaucaccgacgcgguggacugcgcccucgacccccuguccgagaccaagugcacgcucaagagcuucaccguggagaaggggaucuaccagaccuccaacuuccgcguccagcccaccgagagcaucgugcgguuccccaacaucacgaaccucugcccguucggcgaggucuucaacgccacccgcuucgccuccguguacgccuggaaccggaagcgcaucagcaacugcguggcggacuacuccguccuguacaacagcgccuccuucagcaccuucaagugcuacggggugucccccaccaagcugaacgaccucugcuucacgaacguguacgccgacagcuucgucauccggggcgacgaggugcgccagaucgcccccggccagaccgggaagaucgccgacuacaacuacaagcugcccgacgacuucaccggcugcgugaucgcguggaacuccaacaaccuggacagcaaggucgggggcaacuacaacuaccaguaccggcuguuccgcaaguccaaccugaagccguucgagcgggacaucagcaccgagaucuaccaggccggguccacgcccugcaacggcguggagggcuucaacugcuacagcccccugcaguccuacggguuccagcccaccaacggcgugggguaccagccguaccgcgucguggugcucagcuucgagcugcugcacgcccccgccaccgucugcggccccaagaaguccaccaaccucgugaagaacaagugcgugaacuucaacuucaacgggcugacgggcaccggcguccugaccgaguccaacaagaaguuccuccccuuccagcaguucgggcgggacaucgccgacaccaccgacgcggugcgcgacccgcagacgcuggagauccuggacaucacccccugcagcuucggcgggguguccgucaucacccccggcaccaacacgagcaaccagguggccgugcuguaccagggggucaacugcaccgaggugccgguggccauccacgccgaccagcucacccccaccuggcgcgucuacuccacgggcagcaacguguuccagacccgggccggcugccugaucggggcggagcacgugaacaacuccuacgagugcgacauccccaucggcgccgggaucugcgccagcuaccagacccagaccaacagcccccgccgggcccgcagcgucgcgucccagagcaucaucgccuacacgaugucccugggcgccgagaacagcguggccuacuccaacaacagcaucgccaucccgaccaacuucaccaucuccgugaccacggagauccuccccgucagcaugaccaagaccagcguggacugcaccauguacaucugcggcgacuccacggagugcagcaaccugcugcuccaguacggguccuucugcacccagcugaaccgggcgcugaccggcaucgccguggagcaggacaagaacacccaggaggucuucgcccaggugaagcagaucuacaagacgccgcccaucaaggacuucgggggcuucaacuucagccagauccuccccgaccccuccaagcccagcaagcgcuccuucaucgaggaccugcuguucaacaaggugacccucgccgacgccggguucaucaagcaguacggcgacugccugggcgacaucgcggcccgggaccugaucugcgcccagaaguucaacgggcucaacguccugcccccgcugcucaccgacgagaugaucgcccaguacaccagcgcccugcuggcgggcacgaucaccuccggguggaccuucggcgccggggccgcccuccagauccccuucgcgaugcagauggccuaccgcuucaacggcaucggcgugacccagaacgugcuguacgagaaccagaagcugaucgccaaccaguucaacagcgccaucgggaagauccaggacucccucagcuccacggccagcgcgcugggcaagcugcaggacgucgugaaccagaacgcccaggcccucaacacccuggugaagcagcuguccagcaacuucggggccaucuccagcguccucaacgacauccugucccggcuggacccgcccgaggccgaggugcagaucgaccgccucaucaccggccggcugcagagccugcagaccuacgugacgcagcagcucauccgcgcggccgagauccgggccagcgccaaccuggccgcgaccaagauguccgagugcguccuggggcagagcaagcgcguggacuucugcggcaagggcuaccaccucauguccuucccccagagcgcgccccacgggguggucuuccugcacgugaccuacguccccgcccaggagaagaacuucaccaccgcccccgccaucugccacgacggcaaggcccacuucccgcgggaggggguguucguguccaacggcacgcacugguucgucacccagcgcaacuucuacgagccccagaucaucaccaccgacaacacguucgugagcgggaacugcgacguggucaucggcaucgugaacaacaccguguacgacccccugcagcccgagcucgacuccuucaaggaggagcuggacaaguacuucaagaaccacaccagcccggacgucgaccugggcgacaucuccgggaucaacgccagcguggugaacauccagaaggagaucgaccggcucaacgaggucgccaagaaccugaacgagucccugaucgaccuccaggagcugggcaaguacgagcaguacaucaaguggcccugguacaucuggcugggguucaucgccggccucaucgcgaucgugauggugaccaucaugcugugcugcaugacgagcugcugcuccugccugaagggcugcugcagcugcggguccugcugcaaguucgacgaggacgacagcgagcccguccucaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27731 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27732 - RNA, 4009 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagaaagcuuaccauguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccucauggaccuggagggcaagcaggggaacuucaagaaccugcgcgaguucguguucaagaacaucgacggcuacuucaagaucuacuccaagcacacgccgaucaaccucguccgggaccugccccagggguucagcgcccuggagccccucguggaccugcccaucggcaucaacaucacccgcuuccagacccugcucgcccugcaccgguccuaccugacccccgggggcagcagcuccggcuggacggcgggggccgccgccuacuacgugggcuaccuccagccccgcaccuuccugcugaaguacaacgagaacgggaccaucaccgacgcggucgacugcgcccucgacccccugagcgagacgaagugcacccugaaguccuucaccguggagaagggcaucuaccagaccagcaacuuccgggugcagcccacggaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccaccuucaagugcuacggggucagccccacgaagcugaacgaccucugcuucaccaacguguacgccgacuccuucgugauccgcggcgacgagguccggcagaucgcccccgggcagaccggcaagaucgccgacuacaacuacaagcugccggacgacuucaccgggugcgugaucgcguggaacagcaacaaccuggacuccaaggugggcggcaacuacaacuaccucuaccgccuguuccgcaagagcaaccugaagcccuucgagcgggacaucuccacggagaucuaccaggccgggagcacccccugcaacggcgucaagggguucaacugcuacuucccccuccaguccuacggcuuccagccgaccaacggggugggcuaccagcccuaccggguggucgugcugagcuucgagcugcuccacgcccccgccaccgugugcggccccaagaaguccacgaaccuggucaagaacaagugcgugaacuucaacuucaacgggcugaccggcaccggggugcucaccgagagcaacaagaaguuccugccguuccagcaguucggccgcgacaucgccgacaccacggacgcgguccgcgacccccagacccuggagauccuggacaucacccccugcagcuucgggggcguguccgugaucaccccgggcacgaacaccagcaaccaggucgccgugcucuaccagggggugaacugcaccgagguccccguggccauccacgccgaccagcugacccccacguggcggguguacuccaccggcagcaacgucuuccagacccgcgccgggugccugaucggcgcggagcacgugaacaacuccuacgagugcgacauccccaucggcgccgggaucugcgccagcuaccagacccagacgaacuccccgcggcgcgcccggagcguggcgucccagagcaucaucgccuacaccaugucccucggcgucgagaacagcguggccuacuccaacaacagcaucgccauccccaccaacuucaccaucuccgugacgaccgagauccugcccgucagcaugaccaagaccagcguggacugcacgauguacaucugcggggacuccaccgagugcagcaaccugcuccugcaguacggcuccuucugcacccagcugaaccgcgcccucaccgggaucgcgguggagcaggacaagaacacgcaggaggucuucgcccaggugaagcagaucuacaagacgcccccgaucaaggacuucggcggcuucaacuucagccagauccugcccgaccccuccaagcccagcaagcgguccuucaucgaggaccuccuguucaacaaggugacccuggccgacgccggguucaucaagcaguacggcgacugccugggggacaucgccgcgcgcgaccucaucugcgcccagaaguucaacggccugaccguccugccgccccuccugaccgacgagaugaucgcccaguacaccagcgcccugcucgccgggaccaucaccuccggcuggacguucggcgcgggggccgcccugcagauccccuucgccaugcagauggcguaccgguucaacggcaucggggugacccagaacgugcuguacgagaaccagaagcucaucgccaaccaguucaacagcgccaucggcaagauccaggacucccugagcuccaccgccagcgcccuggggaagcuccaggacgucgugaaccagaacgcgcaggcccugaacacccuggugaagcagcucuccagcaacuucggcgccaucuccagcguccugaacgacauccugucccgccucgacccgccggaggccgaggugcagaucgaccggcugaucacgggccgccugcagagccuccagaccuacgugacccagcagcugauccgggccgcggagauccgcgccagcgccaaccuggccgccaccaagauguccgagugcguccucgggcagagcaagcggguggacuucugcggcaagggguaccaccugauguccuucccccagagcgcgccccacggcguggucuuccugcacgugaccuacguccccgcccaggagaagaacuucacgaccgccccggccaucugccacgacgggaaggcgcacuucccccgcgagggcguguucguguccaacggcacccacugguucgucacccagcggaacuucuacgagccccagaucaucacgaccgacaacaccuucgugagcgggaacugcgacguggucaucggcaucgugaacaacaccguguacgacccccuccagccggagcuggacuccuucaaggaggagcuggacaaguacuucaagaaccacacgagccccgacgucgaccucggggacaucuccggcaucaacgccagcguggugaacauccagaaggagaucgaccgccugaacgaggucgccaagaaccugaacgagucccucaucgaccugcaggagcugggcaaguacgagcaguacaucaaguggcccugguacaucuggcucggguucaucgccggccugaucgccaucgugauggugaccaucaugcugugcugcaugaccagcugcugcuccugccucaaggggugcugcagcugcggcuccugcugcaaguucgacgaggacgacagcgagccgguccugaagggggugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27733 - RNA, 4009 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagaaagcuuaccauguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccucauggaccuggagggcaagcaggggaacuucaagaaccugcgcgaguucguguucaagaacaucgacggcuacuucaagaucuacuccaagcacacgccgaucaaccucguccgggaccugccccagggguucagcgcccuggagccccucguggaccugcccaucggcaucaacaucacccgcuuccagacccugcucgcccugcaccgguccuaccugacccccgggggcagcagcuccggcuggacggcgggggccgccgccuacuacgugggcuaccuccagccccgcaccuuccugcugaaguacaacgagaacgggaccaucaccgacgcggucgacugcgcccucgacccccugagcgagacgaagugcacccugaaguccuucaccguggagaagggcaucuaccagaccagcaacuuccgggugcagcccacggaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccaccuucaagugcuacggggucagccccacgaagcugaacgaccucugcuucaccaacguguacgccgacuccuucgugauccgcggcgacgagguccggcagaucgcccccgggcagaccggcaagaucgccgacuacaacuacaagcugccggacgacuucaccgggugcgugaucgcguggaacagcaacaaccuggacuccaaggugggcggcaacuacaacuaccucuaccgccuguuccgcaagagcaaccugaagcccuucgagcgggacaucuccacggagaucuaccaggccgggaacacccccugcaacggcgucgagggguucaacugcuacuucccccuccagagcuacggcuuccagccgaccaacggggugggcuaccagcccuaccggguggucgugcuguccuucgagcugcuccacgcccccgccaccgugugcggccccaagaaguccacgaaccuggucaagaacaagugcgugaacuucaacuucaacgggcugaccggcaccggggugcucaccgagagcaacaagaaguuccugccguuccagcaguucggccgcgacaucgccgacaccacggacgcgguccgcgacccccagacccuggagauccuggacaucacccccugcagcuucgggggcgugagcgugaucaccccgggcacgaacaccuccaaccaggucgccgugcucuaccagggggugaacugcaccgagguccccguggccauccacgccgaccagcugacccccacguggcggguguacagcaccggcuccaacgucuuccagacccgcgccgggugccugaucggcgcggagcacgugaacaacagcuacgagugcgacauccccaucggcgccgggaucugcgccuccuaccagacccagacgaacagcccgcggcgcgcccgguccguggcgagccaguccaucaucgccuacaccaugagccucggcgccgagaacuccgucgccuacagcaacaacuccaucgccauccccaccaacuucaccaucagcgugacgaccgagauccugcccguguccaugaccaagaccagcgucgacugcacgauguacaucugcggggacagcaccgagugcuccaaccugcuccugcaguacggcagcuucugcacccagcugaaccgcgcgcucaccgggaucgccguggagcaggacaagaacacgcaggagguguucgcccaggucaagcagaucuacaagacgcccccgaucaaggacuucggcggcuucaacuucucccagauccugcccgaccccagcaagcccuccaagcggagcuucaucgaggaccuccuguucaacaaggugacccuggccgacgccggguucaucaagcaguacggcgacugccugggggacaucgcggcccgcgaccucaucugcgcccagaaguucaacggccugaccgugcugccgccccuccugaccgacgagaugaucgcccaguacaccuccgcccugcucgcggggaccaucaccagcggcuggacguucggcgccggggccgcccugcagauccccuucgcgaugcagauggccuaccgguucaacggcaucggggucacccagaacgugcuguacgagaaccagaagcucaucgccaaccaguucaacuccgccaucggcaagauccaggacagccuguccagcaccgccuccgcgcuggggaagcuccaggacguggucaaccagaacgcccgcgcccugaacacccuggugaagcagcucagcuccaacuucggcgccaucagcuccgugcugaacgacauccugagccggcucgacccgccggaggccgagguccagaucgaccgccugaucacgggccggcugcagucccuccagaccuacgugacccagcagcugauccgcgcggccgagauccgggccagcgccaaccuggccgcgaccaagaugagcgagugcgugcucgggcaguccaagcgcgucgacuucugcggcaagggguaccaccugaugagcuucccccaguccgcgccccacggcgugguguuccugcacgucaccuacgugcccgcccaggagaagaacuucacgaccgccccggccaucugccacgacgggaaggcccacuucccccgggagggcgucuucgugagcaacggcacccacugguucgugacccagcgcaacuucuacgagccccagaucaucacgaccgacaacaccuucgucuccgggaacugcgacguggugaucggcaucgucaacaacaccguguacgacccccuccagccggagcuggacagcuucaaggaggagcuggacaaguacuucaagaaccacacgucccccgacguggaccucggggacaucagcggcaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggguucaucgccggccugaucgcgaucgucauggugaccaucaugcugugcugcaugaccuccugcugcagcugccucaaggggugcugcuccugcggcagcugcugcaaguucgacgaggacgacuccgagccggugcugaagggggucaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27734 - RNA, 4009 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccucgagggcaagcaggggaacuucaagaaccugcgcgaguucguguucaagaacaucgacggcuacuucaagaucuacuccaagcacaccccgaucaaccugguccgggaccucccccagggguucagcgcccuggagccccugguggaccuccccaucggcaucaacaucacccgcuuccagacccugcuggcccuccaccgguccuaccugacgccgggggacagcagcuccggcuggaccgcgggcgccgccgccuacuacgugggguaccugcagccccgcaccuuccuccugaaguacaacgagaacggcaccaucacggacgcggucgacugcgcccuggacccccucagcgagaccaagugcacccugaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccucuacaacuccgccagcuucuccacguucaagugcuacggcgugagccccaccaagcugaacgaccugugcuucaccaacgucuacgccgacuccuucgugauccgcggggacgaggugcggcagaucgcccccggccagaccgggaagaucgccgacuacaacuacaagcucccggacgacuucacgggcugcgucaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccucagcuucgagcugcugcacgcccccgccacggugugcggccccaagaaguccaccaaccucgugaagaacaagugcgucaacuucaacuucaacggccugaccgggaccggcgugcugaccgagagcaacaagaaguuccugccguuccagcaguucgggcgcgacaucgccgacacgaccgacgcggugcgcgacccccagacccucgagauccuggacaucacccccugcagcuucggcggggucuccgugaucacgccgggcaccaacaccagcaaccagguggccguccuguaccacgacgugaacugcaccgaggugcccgucgccauccacgccgaccagcucacgcccaccuggcggguguacuccaccggcagcaacguguuccagacccgcgccgggugccugaucggcgcggagcacgucaacaacuccuacgagugcgacauccccaucggggccggcaucugcgccagcuaccagacgcagaccaacucccggcgccgggcccgcagcguggcgucccagagcaucaucgccuacaccaugucccugggcgccgagaacagcguggccuacuccaacaacagcaucgccaucccgaccaacuucacgaucuccgucaccaccgagauccuccccgugagcaugaccaagacgagcguggacugcaccauguacaucugcggggacuccaccgagugcagcaaccugcugcuccaguacggcuccuucugcacccagcugaaccgggcgcugacggggaucgccgucgagcaggacaagaacacccaggagguguucgcccaggugaagcagaucuacaagaccccgcccaucaaggacuucggcggguucaacuucagccagauccuccccgaccccuccaagcccagcaagcgcuccuucaucgaggaccugcuguucaacaaggucacccucgccgacgccggcuucaucaagcaguacggcgacugccugggggacaucgcggcccgggaccugaucugcgcccagaaguucaacggccucacggugcugcccccgcugcucaccgacgagaugaucgcccaguacaccagcgcccugcuggcggggaccaucacguccggcuggaccuucggggccggcgccgcccuccagauccccuucgcgaugcagauggccuaccgcuucaacggcaucggggugacccagaacguccuguacgagaaccagaagcugaucgccaaccaguucaacagcgccaucggcaagauccaggacucccucagcuccaccgccagcgcgcuggggaagcugcaggacguggugaaccagaacgcccaggcccucaacacgcuggucaagcagcuguccagcaacuucggcgccaucuccagcgugcucaacgacauccugucccggcuggacccgcccgaggccgaggugcagaucgaccgccucaucaccgggcggcugcagagccugcagaccuacgucacccagcagcucauccgcgcggccgagauccgggccagcgccaaccuggccgcgaccaagauguccgagugcgugcugggccagagcaagcgcguggacuucugcggcaagggguaccaccucauguccuucccccagagcgcgccccacggcgucguguuccugcacgugacguacguccccgcccaggagaagaacuucaccaccgcccccgccaucugccacgacgggaaggcccacuucccgcgggagggcguguucgucuccaacgggacccacugguucgugacgcagcgcaacuucuacgagccccagaucaucaccaccgacaacaccuucgugagcggcaacugcgacgucgugaucggcaucgugaacaacacggucuacgacccccugcagcccgagcucgacuccuucaaggaggagcuggacaaguacuucaagaaccacaccagcccggacguggaccugggggacaucuccggcaucaacgccagcguggucaacauccagaaggagaucgaccggcucaacgagguggccaagaaccugaacgagucccugaucgaccuccaggagcuggggaaguacgagcaguacaucaaguggcccugguacaucuggcugggcuucaucgccggccucaucgcgaucgugauggucaccaucaugcugugcugcaugaccagcugcugcuccugccugaaggggugcugcagcugcggcuccugcugcaaguucgacgaggacgacagcgagcccgugcucaagggggugaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27735 - RNA, 4009 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacuucagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccgccuguuccggaaguccaaccucaagcccuucgagcgcgacaucagcaccgagaucuaccaggccggcuccacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagccggcgccgggcccgcuccguggcgagccaguccaucaucgccuacaccaugagccugggggccgagaacuccgucgccuacagcaacaacuccaucgccaucccgaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgggcgcugacggugaucgccguggagcaggacaagaacacccaggaggucuucgcccaggugaagcagaucuacaagaccccgcccaucaaggacuucggcggguucaacuucucccagauccugcccgaccccagcaagcccuccaagcgcagcuucaucgaggaccuccuguucaacaaggugacccuggccgacgccggcuucaucaagcaguacggcgacugccucggggacaucgcggcccgggaccugaucugcgcccagaaguucaacggccugacgguccugcccccgcuccugaccgacgagaugaucgcccaguacaccuccgcccuccuggcggggaccaucacgagcggcuggaccuucggggccggcgccgcccugcagauccccuucgcgaugcagauggccuaccgcuucaacggcaucggggugacccagaacgugcucuacgagaaccagaagcugaucgccaaccaguucaacuccgccaucggcaagauccaggacagccuguccagcaccgccuccgcgcucgggaagcugcaggacgucgugaaccagaacgcccaggcccugaacacgcucgugaagcagcugagcuccaacuucggcgccaucagcuccguccugaacgacauccucagccggcuggacccgcccgaggccgaggugcagaucgaccgccugaucaccgggcggcuccagucccugcagaccuacgugacccagcagcugauccgcgcggccgagauccgggccagcgccaaccucgccgcgaccaagaugagcgagugcguccugggccaguccaagcgcguggacuucugcggcaagggguaccaccugaugagcuucccccaguccgcgccccacggcguggucuuccuccacgugacguacguccccgcccaggagaagaacuucaccaccgcccccgccaucugccacgacgggaaggcccacuucccgcgggagggcguguucgugagcaacgggacccacugguucgucacgcagcgcaacuucuacgagccccagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccuccccggacgucgaccugggggacaucagcggcaucaacgccuccguggugaacauccagaaggagaucgaccggcugaacgaggucgccaagaaccucaacgagagccugaucgaccugcaggagcucgggaaguacgagcaguacaucaaguggcccugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27736 - RNA, 3991 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagaaagcuuaccauguucguguuccugguccuccugccccuggugagcucccagugcgugaaccucaccacccgcacgcagcugccgagcgccuacaccaacuccuucacccggggcgucuacuaccccgacaagguguuccgcagcuccgugcugcacagcacccaggaccucuuccugcccuucuucuccaacgucacgugguuccacgccaucagcgggaccaacggcaccaagcgguucgacaaccccgugcugccguucaacgacgggguguacuucgcguccaccgagaaguccaacaucauccgcggcuggaucuucgggacgacccucgacagcaagacccagagccugcugaucgucaacaacgccaccaacgccgugaucaaggugugcgaguuccaguucugcaacgaccccuuccucggcgucuaccacaagaacaacaaguccuggauggagagcgaguuccggguguacuccagcgccaacaacugcacguucgaguacgugucccagcccuuccugauggaccuggagggcaagcaggggaacuucaagaaccuccgcgaguucgucuucaagaacaucgacggcuacuucaagaucuacagcaagcacacccccaucaaccuggugcgggaccugccgcagggguucuccgcccucgagccccugguggaccugcccaucggcaucaacaucacccgcuuccagacccucuaccggagcuaccugacgcccggggacagcuccagcggcuggaccgcgggcgccgccgccuacuacgucggguaccugcagccgcgcaccuuccuccugaaguacaacgagaacggcaccaucacggacgcgguggacugcgcccuggacccccucuccgagaccaagugcacccucaagagcuucaccguggagaaggggaucuaccagacguccaacuuccggguccagcccaccgagagcaucgugcgcuuccccaacaucaccaaccugugcccguucggcgagguguucaacgccacccgguucgccuccgucuacgccuggaaccgcaagcggaucagcaacugcguggcggacuacuccguccuguacaacagcgccuccuucagcacguucaagugcuacggcgugucccccaccaagcugaacgaccugugcuucaccaacguguacgccgacagcuucgucauccgcggggacgaggugcggcagaucgcccccggccagaccgggaagaucgccgacuacaacuacaagcuccccgacgacuucacgggcugcgugaucgcguggaacuccaacaaccuggacagcaaggucgggggcaacuacaacuaccuguaccgccucuuccggaaguccaaccugaagccguucgagcgcgacaucagcaccgagaucuaccaggccggcaacacccccugcaacggggugaagggcuucaacugcuacuucccccugcaguccuacggguuccagcccaccaacggcgugggguaccagccguaccgggucguggugcucagcuucgagcugcugcacgcccccgccacggucugcggccccaagaaguccaccaaccucgugaagaacaagugcgugaacuucaacuucaacggccugaccgggaccggcguccugaccgagagcaacaagaaguuccuccccuuccagcaguucgggcgcgacaucgccgacacgaccgacgcggugcgcgacccgcagacccuggagauccuggacaucacccccugcagcuucggcgggguguccgucaucacgcccggcaccaacaccagcaaccagguggccgugcuguaccagggcgucaacugcaccgaggugccgguggccauccacgccgaccagcucacgcccaccuggcgggucuacuccaccgggagcaacguguuccagacccgcgccggcugccugaucggggcggagcacgugaacaacuccuacgagugcgacauccccaucggcgccggcaucugcgccagcuaccagacgcagaccaacucccaccggcgcgcccggagcgucgcgucccagagcaucaucgccuacaccaugucccugggggccgagaacagcguggccuacuccaacaacagcaucgccauccccaccaacuucacgaucuccgugaccaccgagauccucccggucagcaugaccaagacgagcguggacugcaccauguacaucugcggcgacuccaccgagugcagcaaccugcugcuccaguacggguccuucugcacccagcugaaccgcgcgcugacgggcaucgccguggagcaggacaagaacacccaggaggucuucgcccaggugaagcagaucuacaagaccccgcccaucaaggacuucgggggcuucaacuucagccagauccuccccgaccccuccaagcccagcaagcgguccuucaucgaggaccugcuguucaacaaggugacccucgccgacgccggcuucaucaagcaguacggggacugccugggcgacaucgcggcccgcgaccugaucugcgcccagaaguucaacgggcucacgguccugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgugacccagaacgugcuguacgagaaccagaagcugaucgccaaccaguucaacagcgccaucgggaagauccaggacucccucagcuccaccgccagcgcgcugggcaagcugcaggacgucgugaaccagaacgcccaggcccucaacacgcuggugaagcagcuguccagcaacuucggggccaucuccagcguccucaacgacauccugucccgccuggacccgcccgaggccgaggugcagaucgaccggcucaucaccggccgccugcagagccugcagaccuacgugacccagcagcucauccgggcggccgagauccgcgccagcgccaaccuggccgcgaucaagauguccgagugcguccugggccagagcaagcggguggacuucugcgggaagggcuaccaccucauguccuucccccagagcgcgccccacgggguggucuuccugcacgugaccuacgugcccgcccaggagaagaacuucacgaccgcccccgccaucugccacgacggcaaggcccacuucccccgcgagggggucuucguguccaacggcacccacugguucgucacccagcggaacuucuacgagccgcagaucaucacgacccacaacaccuucgugagcggcaacugcgacguggucaucgggaucgugaacaacaccguguacgacccccugcagcccgagcucgacuccuucaaggaggagcuggacaaguacuucaagaaccacacgagccccgacgucgaccugggcgacaucuccgggaucaacgccagcguggugaacauccagaaggagaucgaccgccucaacgaggucgccaagaaccugaacgagucccugaucgaccuccaggagcugggcaaguacgagcaguacaucaaguggccgugguacaucuggcugggcuucaucgccgggcucaucgcgaucgugauggugaccaucaugcugugcugcaugaccagcugcugcuccugccugaagggcugcugcagcugcggguccugcugcaaguucgacgaggacgacagcgagcccguccucaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27737 - RNA, 4012 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcucgacagcaagacccagucccugcugaucgugaacaacgccaccaacguggucaucaaggugugcgaguuccaguucugcaacgaccccuuccucggcgugaccagcaaccacaagaacaacaaguccuggauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacagcuccagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccaccaaguucgccuccgucuacgccuggaaccggaagcgcaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccggcuguuccgcaaguccaaccucaagcccuucgagcgggacaucagcaccgagaucuaccaggccggcuccacccccugcaacggggugaagggcuucaacugcuacuucccccugcagagcuacggguuccagccgaccuacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgggacaucgccgacacgaccgacgcgguccgcgacccccagacccuggagauccucgacaucacccccugcuccuucggcggggugagcgugaucacgccgggcaccaacaccuccaaccaggucgccgugcuguaccagggcgugaacugcaccgagguccccguggccauccacgccgaccagcugacgcccaccuggcgcguguacagcaccggguccaacgucuuccagacccgggccggcugccucaucggggcggagcacgugaacaacagcuacgagugcgacauccccaucggcgccggcaucugcgccuccuaccagacgcagaccaacagccaccgccgggcccgcuccguggcgagccaguccaucaucgccuacaccaugagccugggggccgagaacuccgucgccuacagcaacaacuccaucgccaucccgaccaacuucacgaucagcgugaccaccgagauccugcccgugagcaugaccaagacguccgucgacugcaccauguacaucugcggcgacagcaccgagugcuccaaccuccugcugcaguacgggagcuucugcacccagcucaaccgggcgcugacgggcaucgccguggagcaggacaagaacacccaggagguguucgcccaggucaagcagaucuacaagaccccgcccaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccucggcgacaucgcggcccgggaccugaucugcgcccagaaguucaacgggcugacggugcugcccccgcuccugaccgacgagaugaucgcccaguacaccuccgcccuccuggcgggcaccaucacgagcggguggaccuucggcgccggcgccgcccugcagauccccuucgcgaugcagauggccuaccgcuucaacgggaucggcgucacccagaacgugcucuacgagaaccagaagcugaucgccaaccaguucaacuccgccaucgggaagauccaggacagccuguccagcaccgccuccgcgcucggcaagcugcagaacguggucaaccagaacgcccaggcccugaacacgcucgugaagcagcugagcuccaacuucggggccaucagcuccgugcugaacgacauccucagccggcuggacccgcccgaggccgagguccagaucgaccgccugaucaccggccggcuccagagccugcagaccuacgugacccagcagcugauccgcgcggccgagauccgggccuccgccaaccucgccgcgaccaagaugagcgagugcgugcugggccaguccaagcgcgucgacuucugcgggaagggcuaccaccugaugagcuucccccaguccgcgccccacggggugguguuccuccacgucacguacgugcccgcccaggagaagaacuucaccaccgcccccgccaucugccacgacggcaaggcccacuucccgcgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccugcagcccgagcuggacagcuucaaggaggagcucgacaaguacuucaagaaccacaccuccccggacguggaccugggcgacaucagcgggaucaacgccuccgucgugaacauccagaaggagaucgaccggcugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagcccgugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27738 - RNA, 4018 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggaccgaccgcgaccugccccagggguucagcgcccucgagccccugguggaccugcccaucggcaucaacaucacccgguuccagacgcuccuggcccugcaccgcuccuaccucaccccgggggacagcagcuccggcuggaccgcgggcgccgccgccuacuacgugggguaccugcagccccggaccuuccugcucaaguacaacgagaacggcacgaucaccgacgcggucgacugcgcccuggacccccugagcgagaccaagugcacccucaaguccuucacgguggagaaggggaucuaccagaccagcaacuuccgcgugcagcccaccgaguccaucguccgguucccgaacaucaccaaccugugccccuucggcgagguguucaacgccacgcgcuucgccagcgucuacgccuggaaccggaagcgcaucuccaacugcguggcggacuacagcgugcuguacaacuccgccagcuucuccaccuucaagugcuacggcgucagccccaccaagcucaacgaccugugcuucaccaacguguacgccgacuccuucgugauccgcggggacgagguccggcagaucgcccccggcaagacggggaagaucgccgacuacaacuacaagcugccggacgacuucaccggcugcgugaucgcguggaacagcaacaaccucgacuccaaggucgggggcaacuacaaguaccuguaccggcuguuccgcaagagcaaccucaagcccuucgagcgggacaucuccaccgagaucuaccaggccggcagcacccccugcaacgggguggagggcuucaacugcuacuucccccugcaguccuacggguuccagccgacgaacggcgugggguaccagcccuaccgcguggucgugcugagcuucgagcuccugcacgcccccgccaccgugugcggccccaagaaguccaccaaccuggucaagaacaagugcgugaacuucaacuucaacggccucaccgggaccggcgugcugacggagagcaacaagaaguuccugccguuccagcaguucgggcgcgacaucgccgacaccaccgacgcgguccgggacccccagacccuggagauccucgacaucacgcccugcagcuucggcgggguguccgugaucaccccgggcaccaacaccagcaaccaggucgccgugcuguaccagggcgugaacugcacggagguccccguggccauccacgccgaccagcugacccccaccuggcgcguguacuccaccgggagcaacgucuuccagacgcgggccggcugccucaucggggcggagcacgugaacaacuccuacgagugcgacauccccaucggcgccggcaucugcgccagcuaccagacccagaccaacuccccgcgccgggcccgcagcguggcgucccagagcaucaucgccuacaccaugucccugggggccgagaacagcgucgccuacuccaacaacagcaucgccauccccaucaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccucggcgacaucgcggcccgggaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgcuucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccggcuggacccgcccgaggccgagguccagaucgaccgccugaucaccggccggcuccagagccugcagaccuacgugacccagcagcugauccgcgcggccgagauccgggccagcgccaaccucgccgcgaccaagauguccgagugcgugcugggccagagcaagcgcgucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgggagggggucuucguguccaacggcacccacugguucgugacgcagcgcaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccggcugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27739 - RNA, 4009 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccaccgugugcggccccaagaaguccacgaaccuggucaagaacaagugcgugaacuucaacuucaacggccucaccgggaccggcgugcugaccgagagcaacaagaaguuccugccguuccagcaguucgggcgcgacaucgccgacaccacggacgcgguccgcgacccccagacccuggagauccucgacaucacccccugcagcuucggcgggguguccgugaucaccccgggcacgaacaccagcaaccaggucgccgugcuguaccagggcgugaacugcaccgagguccccguggccauccacgccgaccagcugacccccacguggcggguguacuccaccgggagcaacgucuuccagacccgcgccggcugccucaucggggcggagcacgugaacaacuccuacgagugcgacauccccaucggcgccggcaucugcgccagcuaccagacccagacgaacucccaccggcgcgcccggagcguggcgucccagagcaucaucgccuacaccaugucccugggggccgagaacagcgucgccuacuccaacaacagcaucgccaucccgaccaacuucaccaucuccgugacgaccgagauccugcccgugagcauggcgaagaccagcgucgacugcaccauguacaucugcggcgacuccacggagugcagcaaccuccugcugcaguacggguccuucugcacccagcucaaccgcgcccugaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgguccuucaucgaggaccuccuguucaacaaggugacccuggccgacgcgggcuucaucaagcaguacggggacugccucggcgacaucgccgcccgcgaccugaucugcgcccagaaguucaacgggcugaccgugcugcccccgcuccugaccgacgagaugaucgcccaguacacgagcgcgcuccuggccggcaccaucaccuccggguggaccuucggcgccggcgccgcgcugcagauccccuucgccaugcagauggccuaccgguucaacgggaucggcgucacgcagaacgugcucuacgagaaccagaagcugaucgccaaccaguucaacagcgccaucgggaagauccaggacucccugagcuccaccgcgagcgcccucggcaagcugcaggacguggucaaccagaacgcccaggcccugaacacccucgugaagcagcuguccagcaacuucggggccaucuccagcgugcugaacgacauccucucccgccuggacccgcccgaggcggagguccagaucgaccggcugaucaccggccgccuccagagccugcagacguacgugacccagcagcugauccgggccgccgagauccgcgccagcgccaaccucgcggccaccaagauguccgagugcgugcugggccagagcaagcgggucgacuucugcgggaagggcuaccaccugauguccuucccccagagcgcgccccacggggugguguuccuccacgucaccuacgugcccgcccaggagaagaacuucaccacggcccccgccaucugccacgacggcaaggcccacuucccgcgcgagggggucuucguguccaacggcacccacugguucgugacccagcggaacuucuacgagccccagaucaucaccacggacaacaccuucgucagcggcaacugcgacguggugaucgggaucgucaacaacaccguguacgacccccugcagcccgagcuggacuccuucaaggaggagcucgacaaguacuucaagaaccacaccagcccggacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgcggggcugaucgccaucgucauggugacgaucaugcucugcugcaugaccagcugcugcuccugccugaagggcugcugcagcugcggguccugcugcaaguucgacgaggacgacagcgagcccgugcugaagggcgucaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27740 - RNA, 4009 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacucccaccggcgcgcccggagcguggcgucccagagcaucaucgccuacaccaugucccugggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugacggugcugcccccgcuccugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgcccccgccaucugccacgacggcaaggcccacuucccgcgcaagggggucuucguguccaacggcaccuacugguucgugacgcagcggaacuucuacgagccccagaucaucaccaccgacaacaccuucgucagcggcaacugcgacguggugaucgggaucgucaacaacacgguguacgacccccugcagcccgagcuggacuccuucaaggaggagcucgacaaguacuucaagaaccacaccagcccggacguggaccugggcgacaucuccgggaucaacgccagcuucgucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27741 - RNA, 4003 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguucgacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgugguccacaagaacaacaagagcuggauggaguccgaguuccggguguacagcuccgccaacaacugcacguucgaguacgugagccagcccuuccugauggaccuggagggcaagcagggcaacuucaagaaccuccgcgaguucgucuucaagaacaucgacggguacuucaagaucuacuccaagcacaccccgaucaaccuggugcggggccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgucggguaccugcagccccgcaccuuccugcucaaguacaacgagaacggcaccaucacggacgcgguggacugcgcccuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggcggacuacagcguccuguacaacuccgccagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgcggacacgaccgacgccguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgcgggcugccucaucggggccgaguacgugaacaacuccuacgagugcgacauccccaucggcgccagcaucugcgccuccuaccagacgcagaccaacagcccgcggcgcgcgcgguccguggccagccaguccaucaucgccuacaccaugagccugggcgccgagaacuccgucgccuacagcaacaacuccaucgcgauccccaccaacuucacgaucagcgugaccaccgagauccugcccgugagcaugaccaagacguccgucgacugcaccauguacaucugcggggacagcaccgagugcuccaaccuccugcugcaguacggcagcuucugcacccagcucaaccgcgcccugacggggaucgccguggagcaggacaagaacacccaggagguguucgcccaggucaagcagaucuacaagacgcccccgaucaaggacuucggcggguucaacuucucccagauccugcccgaccccagcaagcccuccaagcggagcuucaucgaggaccuccuguucaacaaggugacccuggccgacgcgggcuucaucaagcaguacggcgacugccucggggacaucgccgcccgcgaccugaucugcgcccagaaguucaacggccugaccgugcucccgccccugcugaccgacgagaugaucgcccaguacaccuccgcgcuccuggccgggaccaucacgagcggcuggaccuucggggccggcgccgcgcugcagauccccuucgccaugcagauggccuaccgguucaacggcaucggggucacccagaacgugcucuacgagaaccagaagcugaucgccaaccaguucaacuccgccaucggcaagauccaggacagccuguccagcaccgcguccgcccucgggaagcugcgcgacguggucaaccagaacgcccaggcccugaacacgcucgugaagcagcugagcuccaacuucggcgccaucagcuccgugcugaacgacauccucagccggcuggacccgcccgaggcggagguccagaucgaccgccugaucaccgggcggcuccagagccugcagaccuacgugacccagcagcugauccgcgccgccgagauccgggccuccgccaaccucgcggccaccaagaugagcgagugcgugcugggccaguccaagcgcgucgacuucugcggcaagggguaccaccugaugagcuucccccaguccgcgccccacggcgugguguuccuccacgucacguacgugcccgcccaggagaagaacuucaccaccgccccggccaucugccacgacgggaaggcccacuucccccgggagggcgucuucgugagcaacgggacccacugguucgugacgcagcgcaacuucuacgagccccagaucaucaccaccgacaacaccuucgucuccggcaacugcgacguggugaucggcaucgucaacaacacgguguacgacccccugcagccggagcuggacagcuucaaggaggagcucgacaaguacuucaagaaccacaccucccccgacguggaccugggggacaucagcggcaucaacgccuccgucgugaacauccagaaggagaucgaccggcuggacgagguggccaagaaccucaacgagagccugaucgaccugcaggagcucgggaaguacgagcaguacaucaaguggcccugguacaucuggcugggcuucaucgcgggccugaucgccaucgucauggugaccaucaugcucugcugcaugaccuccugcugcagcugccugaaggggugcugcuccugcggcagcugcugcaaguucgacgaggacgacuccgagccggugcugaagggggucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27742 - RNA, 4006 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccacgaaccuggucaagaacaagugcgugaacuucaacuucaacggccugaccgggaccggcgugcucaccgagagcaacaagaaguuccugccguuccagcaguucgggcgcgacaucgccgacaccacggacgcgguccgggacccccagacccuggagauccuggacaucacccccugcagcuucggcgggguguccgugaucaccccgggcacgaacaccagcaaccaggucgccgugcucuaccaggacgugaacugcaccgagguccccguggccauccacgccgaccagcugacccccacguggcgcguguacuccaccggcagcaacgucuuccagacccgggccgggugccugaucggcgcggagcacgugaacaacuccuacgagugcgacauccccaucggggccggcaucugcgccagcuaccagacccagacgaacucccgccggcgcgcccggagcguggcgucccagagcaucaucgccuacaccaugucccucggcgccgagaacagcgucgccuacuccaacaacagcaucgccaucccgaccaacuucaccaucuccgugacgaccgagauccugcccgugagcaugaccaagaccagcgucgacugcacgauguacaucugcggggacuccaccgagugcagcaaccugcuccugcaguacggcuccuucugcacccagcugaaccgcgcgcucaccgggaucgccguggagcaggacaagaacacgcaggagguguucgcccaggucaagcagaucuacaagaccccgcccaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccugggggacaucgcggcccgcgaccucaucugcgcccagaaguucaacggccugaccgugcugcccccgcuccugacggacgagaugaucgcccaguacaccagcgcccugcucgcggggaccaucaccuccggcuggacguucggggccggcgccgcccugcagauccccuucgcgaugcagauggccuaccgguucaacggcaucggggucacccagaacgugcuguacgagaaccagaagcucaucgccaaccaguucaacagcgccaucggcaagauccaggacucccugagcuccaccgccagcgcgcuggggaagcuccaggacguggucaaccagaacgcccaggcccugaacacccuggugaagcagcucuccagcaacuucggcgccaucuccagcgugcugaacgacauccugucccgccucgacccgcccgaggccgagguccagaucgaccggcugaucacggggcgccugcagagccuccagaccuacgugacccagcagcugauccgggcggccgagauccgcgccagcgccaaccuggccgcgaccaagauguccgagugcgugcucggccagagcaagcgggucgacuucugcggcaagggguaccaccugauguccuucccccagagcgcgccccacggcgugguguuccugcacgucaccuacgugcccgcccaggagaagaacuucacgaccgcccccgccaucugccacgacgggaaggcccacuucccgcgcgagggcgucuucguguccaacgggacccacugguucgugacccagcggaacuucuacgagccccagaucaucacgaccgacaacaccuucgucagcggcaacugcgacguggugaucggcaucgucaacaacaccguguacgacccccuccagcccgagcuggacuccuucaaggaggagcuggacaaguacuucaagaaccacacgagcccggacguggaccucggggacaucuccggcaucaacgccagcgucgugaacauccagaaggagaucgaccgccugaacgagguggccaagaaccugaacgagucccucaucgaccugcaggagcuggggaaguacgagcaguacaucaaguggcccugguacaucuggcucggcuucaucgccggccugaucgcgaucgucauggugaccaucaugcugugcugcaugaccagcugcugcuccugccucaaggggugcugcagcugcggcuccugcugcaaguucgacgaggacgacagcgagcccgugcugaagggggucaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27743 - RNA, 4003 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagaaagcuuaccauguucguguuccugguccuccugccccuggugagcucccagugcgugaaccuccgcacccggacccagcugccgcccgccuacacgaacagcuucacccgcggcgucuacuaccccgacaagguguuccgguccagcgugcugcacuccacccaggaccucuuccugcccuucuucagcaacgucaccugguuccacgccauccacguguccgggacgaacggcaccaagcgcuucgacaacccggugcugcccuucaacgacggggucuacuucgcgagcaccgagaaguccaacaucauccggggcuggaucuucgggaccacgcucgacagcaagacccagucccugcugaucgugaacaacgccaccaacguggucaucaaggugugcgaguuccaguucugcaacgaccccuuccucggcgugcacaagaacaacaagagcuggauggaguccgaguuccgcgucuacagcuccgccaacaacugcaccuucgaguacgugagccagcccuuccugauggaccuggagggcaagcaggggaacuucaagaaccuccgggaguucguguucaagaacaucgacggcuacuucaagaucuacuccaagcacacgccgaucaaccugguccgcgaccugccccagggguucagcgcccucgagccccugguggaccugcccaucggcaucaacaucacccgguuccagacccuccuggcccugcaccgcuccuaccucaccccgggggacagcagcuccggcuggacggcgggcgccgccgccuacuacgugggguaccugcagccccggaccuuccugcucaaguacaacgagaacggcaccaucaccgacgcggucgacugcgcccuggacccccugagcgagacgaagugcacccucaaguccuucaccguggagaaggggaucuaccagaccagcaacuuccgcgugcagcccacggaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcucaacgaccugugcuucaccaacguguacgccgacuccuucgugauccgcggggacgagguccggcagaucgcccccggccagaccgggaagaucgccgacuacaacuacaagcugccggacgacuucaccggcugcgugaucgcguggaacagcaacaaccucgacuccaaggucgggggcaacuacaacuaccgguaccgccuguuccgcaagagcaaccugaagcccuucgagcgggacaucuccacggagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccaccaaccuggucaagaacaagugcgugaacuucaacuucaacggccugacggggaccggcgugcucaccgagagcaacaagaaguuccugccguuccagcaguucgggcgggacaucgccgacaccaccgacgcgguccgcgacccccagacgcuggagauccuggacaucacccccugcagcuucggcgggguguccgugaucaccccgggcaccaacacgagcaaccaggucgccgugcucuaccagggcgugaacugcaccgagguccccguggccauccacgccgaccagcugacccccaccuggcggguguacuccacggggagcaacgucuuccagacccgcgccggcugccugaucggggcggagcacgugaacaacuccuacgagugcgacauccccaucggcgccggcaucugcgccagcuaccagacccagaccaacucccggcgccgggcccgcagcguggcgucccagagcaucaucgccuacacgaugucccucggggccgagaacagcgucgccuacuccaacaacagcaucgccaucccgaccaacuucaccaucuccgugaccacggagauccugcccgugagcaugaccaagaccagcgucgacugcaccauguacaucugcggcgacuccacggagugcagcaaccugcuccugcaguacggguccuucugcacccagcugaaccgggcgcucaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugaccgugcugcccccgcuccugaccgacgagaugaucgcccaguacacgagcgcccugcucgcgggcaccaucaccuccggguggaccuucggcgccggcgccgcccugcagauccccuucgcgaugcagauggccuaccgcuucaacgggaucggcgucacgcagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacccuggugaagcagcucuccagcaacuucggggccaucuccagcgugcugaacgacauccugucccggcucgacccgcccgaggccgagguccagaucgaccgccugaucaccggccggcugcagagccuccagacguacgugacccagcagcugauccgcgcggccgagauccgggccagcgccaaccuggccgcgaccaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucaccacggcccccgccaucugccacgacggcaaggcccacuucccgcgggagggggucuucguguccaacggcacccacugguucgugacccagcgcaacuucuacgagccccagaucaucaccacggacaacaccuucgucagcggcaacugcgacguggugaucgggaucgucaacaacaccguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugacgaucaugcugugcugcaugaccagcugcugcuccugccucaagggcugcugcagcugcggguccugcugcaaguucgacgaggacgacagcgagcccgugcugaagggcgucaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27744 - RNA, 4009 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27745 - RNA, 4009 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27746 - RNA, 4009 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27747 - RNA, 4009 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27748 - RNA, 4009 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27749 - RNA, 4009 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27750 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27751 - RNA, 4009 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27752 - RNA, 4009 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27753 - RNA, 4009 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27754 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27755 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27756 - RNA, 4000 nt, Artificial Sequence
  SARS-CoV-2/Wuhan/WIV05/2019__EPI_ISL_402128 spike protein mRNA gc (1-1273)(K986P_V987P_H69del_V70del_Y144del_N501Y_A570D_D614G_P681 H_T716I_S982A_D1118H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27757 - RNA, 4009 nt, Artificial Sequence
  SARS-CoV-2/Wuhan/WIV05/2019__EPI_ISL_402128 spike protein mRNA gc (1-1273)(K986P_V987P_K417N_E484K_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27758 - RNA, 4000 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_R246 I_K417N_E484K_N501Y_D614G_A701V)
aggagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27759 - RNA, 4009 nt, Artificial Sequence
  SARS-CoV-2/Wuhan/WIV05/2019__EPI_ISL_402128 spike protein mRNA gc (1-1273)(K986P_V987P_E484K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27760 - RNA, 4009 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I)
aggagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27761 - RNA, 4009 nt, Artificial Sequence
  SARS-CoV-2/Wuhan/WIV05/2019__EPI_ISL_402128 spike protein mRNA gc (1-1273)(K986P_V987P_S13I_W152C_L452R_D614G)
aggagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27762 - RNA, 4000 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27763 - RNA, 4000 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27764 - RNA, 4000 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccgcgaccuguuccugcccuucuucagcaacgugaccugguuccacgugaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccacaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacucugggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27765 - RNA, 4000 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgugaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccacaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacucugggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27766 - RNA, 4009 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27767 - RNA, 4009 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27768 - RNA, 4009 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27769 - RNA, 4009 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggaugaagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcgugcagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccacgagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27770 - RNA, 4003 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagaaagcuuaccauguucguguuccuggugcugcugccccuggugagcagccagugcgugaaccugcgcacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgagguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcagaacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27771 - RNA, 3988 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacgugaucaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcacgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccaguaccggcuguuccggaagagcaaccugaagcccuucgagcgggacaucagcaccgagaucuaccaagccggcuccaccccuugcaacggcguggagggcuucaacugcuacagcccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaacgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27772 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27773 - RNA, 4009 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagaaagcuuaccauguucguguucuucgugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcggcagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27774 - RNA, 4009 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagaaagcuuaccauguucguguucuucgugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcggcagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccgcgcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27775 - RNA, 4009 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgagcugcggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcuuccuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccacgacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27776 - RNA, 4009 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacuucagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccgugaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27777 - RNA, 3991 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagaaagcuuaccauguucguguuccuggugcugcugccccuggugagcagccagugcgugaaccugaccacccggacccagcugccaagcgccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacgccgugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccuguaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27778 - RNA, 4012 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcgugaccagcaaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccaccaaguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcagaacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27779 - RNA, 4018 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggaccgaccgcgaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggcaagacaggcaagaucgccgacuacaacuacaagcugcccgacgacuucaccggcugcgugaucgccuggaacagcaacaaccucgacagcaaggugggcggcaacuacaaguaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27780 - RNA, 4009 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcauggccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27781 - RNA, 4009 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccggaagggcguguucgugagcaacggcaccuacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27782 - RNA, 4003 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguucgacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugguggugcacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgccgagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccagcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcgcgacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcuggacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27783 - RNA, 4006 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27784 - RNA, 4003 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagaaagcuuaccauguucguguuccuggugcugcugccccuggugagcagccagugcgugaaccugcgcacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcgugcacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27785 - RNA, 4009 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27786 - RNA, 4009 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27787 - RNA, 4009 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27788 - RNA, 4009 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27789 - RNA, 4009 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27790 - RNA, 4009 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27791 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27792 - RNA, 4009 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27793 - RNA, 4009 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27794 - RNA, 4009 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27795 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27796 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27797 - RNA, 4000 nt, Artificial Sequence
  SARS-CoV-2/Wuhan/WIV05/2019__EPI_ISL_402128 spike protein mRNA gc (1-1273)(K986P_V987P_H69del_V70del_Y144del_N501Y_A570D_D614G_P681 H_T716I_S982A_D1118H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27798 - RNA, 4009 nt, Artificial Sequence
  SARS-CoV-2/Wuhan/WIV05/2019__EPI_ISL_402128 spike protein mRNA gc (1-1273)(K986P_V987P_K417N_E484K_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27799 - RNA, 4000 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_R246 I_K417N_E484K_N501Y_D614G_A701V)
aggagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggaucccccagaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27800 - RNA, 4009 nt, Artificial Sequence
  SARS-CoV-2/Wuhan/WIV05/2019__EPI_ISL_402128 spike protein mRNA gc (1-1273)(K986P_V987P_E484K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27801 - RNA, 4009 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I)
aggagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27802 - RNA, 4009 nt, Artificial Sequence
  SARS-CoV-2/Wuhan/WIV05/2019__EPI_ISL_402128 spike protein mRNA gc (1-1273)(K986P_V987P_S13I_W152C_L452R_D614G)
aggagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27803 - RNA, 4000 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27804 - RNA, 4000 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccauuugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27805 - RNA, 4000 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccgggaccuguuccugcccuucuucagcaacgugaccugguuccacgugaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgccaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugagggaccugccccagggauucagcgcucuggagccucugguggaccugcccaucggcaucaacaucacccgguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccacaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaggagguguucgcccaggugaagcaaaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggacccugggcgccggcgccgcacugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagccggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccucaugagcuuuccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27806 - RNA, 4000 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgugaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgccaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcucuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccacaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaggagguguucgcccaagugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggacccugggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccucaugagcuuuccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27807 - RNA, 4009 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcuucgugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27808 - RNA, 4009 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcuucgugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27809 - RNA, 4009 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27810 - RNA, 4009 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggaugaaguccgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacggugugcagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaagacaagaacacccaggagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccacgagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27811 - RNA, 4003 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N)
aggagaaagcuuaccauguucguguuccuggugcugcugccccuggugagcagccagugcgugaaccugcggacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcguguacuaccacaagaacaacaagagcuggauggagagcgaggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuucaacugcuacuuuccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacaccagcaaccagguggccgugcuguaccagggagugaacugcacagaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugacugugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcagaacguggugaaccagaacgcucaggcccugaacacccuggugaagcagcugagcagcaauuucggcgccaucagcucagugcugaacgacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuuuccccagagcgcuccccacggcgugguguuccugcacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27812 - RNA, 3988 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacgugaucaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgucuacuaccacaagaacaacaagagcuggauggagagcgaguuccggguguacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggcuucagcgcccuggagccucugguggaccugcccaucggaaucaacaucaccagguuccagacccugcuggcccugcacgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcauugugcgguuccccaacaucaccaaccugugucccuucggcgagguguucaacgccacucgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaagaucgccgacuacaacuacaagcugcccgacgacuucaccggcugcgugaucgccuggaacagcaacaaccuggacagcaaggugggcggcaacuacaacuaccaguaccggcuguuccguaagagcaaccugaagcccuucgagcgggacaucagcaccgagaucuaccaggccggcagcaccccaugcaacggcguggagggcuuuaacugcuacagcccccugcagagcuacgguuuccagcccaccaacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggauaucgccgacaccaccgacgcagugcgggacccccagacccuggagauccuggacaucacccccugcagcuucggcggcgucagcgugaucaccccaggcaccaacaccagcaaccagguggccgugcuguaccagggcgugaacugcacagaggugcccguggccauccacgccgaccagcugacccccaccuggcggguguacagcaccggcagcaacguguuccagacccgggccggaugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccauaagcgugaccaccgagauccugccugugagcaugaccaagaccagcguggacuguaccauguacaucugcggcgacagcaccgagugcagcaacuuacugcugcaguacggcagcuucugcacccagcugaaccgggcccugaccggcaucgccguggagcaagacaagaacacccaggagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgccgcucgggaccugaucugcgcccagaaguucaacggccugaacgugcugccuccccugcugacugacgagaugaucgcccaguacaccagcgcccugcuggccgggaccaucaccagcggcuggaccuucggcgccggcgcagcccugcagauccccuucgccaugcagauggccuaccgguucaacggcaucggcgugacccagaacgugcuuuacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcucagugcugaacgacauccugagccggcuggacccacccgaggccgaggugcagaucgacaggcugaucaccggccggcugcagagccugcagaccuacgugacccagcagcugauccgggccgccgagauucgggccagcgccaaccuggcagccaccaagaugagcgagugcgugcugggccagagcaagcggguggacuucugcggcaagggcuaccaccugaugagcuuuccccagagcgcuccccacggcgugguguuccugcacgucaccuacgugcccgcccaggagaagaacuucaccaccgcccccgccaucugccacgacggcaaggcccacuucccccgggagggcguguucgugagcaacggcacacacugguucgugacccagcggaacuucuacgagccccagaucaucaccaccgacaacaccuucgugagcggaaacugcgacguggugaucggcaucgugaacaacaccguguacgacccucugcagcccgagcucgacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27813 - RNA, 4003 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27814 - RNA, 4009 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagaaagcuuaccauguucguguucuucgugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuuuggcaccacccuggacagcaagacccagagccugcugaucgugaacaacgccacaaacguggugaucaaggugugcgaguuccaguucugcaacgaccccuuccugggcguguacuaccacaagaacaacaagagcuggauggagagcgaguuccgggucuacagcagcgcuaacaauugcaccuucgaguacgugagccagcccuuccugauggaccuggagggcaagcagggcaacuucaagaaccuccgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcggcagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcauugugcgguuccccaacaucacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccgguagcacccccugcaacggcgugaagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgauaccaccgacgcagugcgggacccccagacccuggagauccuggacaucaccccaugcagcuucggcggcgugagcgucaucacccccggaaccaacacaagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagaucuuacccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaucugaucugcgcucagaaguucaacggccugaccgugcugcccccucugcugaccgacgagaugaucgcccaguacaccagcgcccugcuggccggcaccaucaccagcggcuggaccuucggcgccggcgccgcacuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucaccuacgugcccgcccaggagaagaacuucacaaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27815 - RNA, 4009 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagaaagcuuaccauguucguguucuucgugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuuuggcaccacccuggacagcaagacccagagccugcugaucgugaacaacgccacaaacguggugaucaaggugugcgaguuccaguucugcaacgaccccuuccugggcguguacuaccacaagaacaacaagagcuggauggagagcgaguuccgggucuacagcagcgcuaacaauugcaccuucgaguacgugagccagcccuuccugauggaccuggagggcaagcagggcaacuucaagaaccuccgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcggcagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcauugugcgguuccccaacaucacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccgguaacacccccugcaacggcguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggacaucgccgauaccaccgacgcagugcgggacccccagacccuggagauccuggacaucaccccaugcagcuucggcggcgugagcgucaucacccccggaaccaacacaagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcucgggaucugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcuagggcccugaacacccuggugaagcagcugagcagcaauuuuggcgccaucagcagcgugcugaacgacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27816 - RNA, 4009 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgagcugcgggucuacagcagcgcuaacaauugcaccuucgaguacgugagccagcccuuccucauggaccuggagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcuuccuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccacgacgugaacugcaccgaggugcccguggccauccacgccgaccagcugacccccaccuggcggguguacagcaccggaagcaacguguuccagacccgggccggcugcuuaaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaggagguguucgcccaagugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugccuccccugcugaccgacgagaugaucgcccaguacaccagcgcccuucuggccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccucaugagcuucccccagagcgcuccccacggcgugguguuccugcacgugacauacgugcccgcccaggagaagaacuucaccaccgcccccgccauuugccacgacggcaaggcccacuucccccgggagggcgucuucgugagcaacggaacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27817 - RNA, 4009 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacuucagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagccggcggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccgugaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgccgcucgggaccugaucugcgcccagaaguucaacgggcugaccgugcugccuccccugcugaccgacgagaugaucgcccaguacaccagcgcccugcuugccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcagcgugcugaaugacauccugucacggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27818 - RNA, 3991 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagaaagcuuaccauguucguguuccuggugcugcugccccuggugagcagccagugcgugaaccugaccacccggacccagcugcccagcgccuacaccaacagcuucacccggggcguguacuacccugacaagguguuccggagcagcgugcugcacagcacccaggaccuguuccugcccuucuucagcaacgugaccugguuccacgccaucagcggcaccaacggcaccaagcgguucgacaaccccgugcugccauucaacgacggcguguacuucgccagcaccgagaagucaaacaucauccggggcuggaucuucggcaccacccuggacagcaagacacagagccugcugaucgugaacaacgccaccaacgcugugaucaaggugugcgaguuucaguucugcaacgaccccuuccugggcguguaccacaagaacaacaagagcuggauggagagcgaguuccggguguacagcagcgccaacaauugcaccuucgaguacgugagccagcccuuccugauggaccucgagggcaagcagggcaacuucaagaaccugcgggaguucgucuucaagaacaucgauggcuacuucaagaucuacagcaagcacacccccaucaaccuggugcgggaccugccccagggauucagcgcccuggagccccugguggaccugccuaucggcaucaacaucaccagguuccagacccuguaccggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuucgagcgggacaucagcaccgagaucuaccaggccggcaacaccccaugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggccccaaaaagagcaccaaccuggugaagaacaagugcgugaauuucaacuucaacggccugaccggcaccggcgugcugaccgagagcaacaagaaguuccugccuuuccagcaguucggccgggauaucgccgacaccaccgacgcagugcgggacccccagacccuggagauccuggacaucacccccugcagcuucggcggcgugagcgugaucaccccaggcacaaacaccagcaaccagguggccguccuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagccugggcgccgagaacagcguggccuacagcaacaacagcaucgcgauccccaccaacuucaccaucagcgugaccaccgagauacugcccgugagcaugaccaagaccagcguggacuguaccauguacaucugcggcgacagcaccgagugcagcaacuuacugcugcaguacggcagcuucugcacccagcugaaccgggcccugaccggcaucgccguggagcaggacaagaacacccaagagguguucgcccaggugaagcagaucuacaagacuccucccaucaaggacuucggcggcuucaacuucagccagauccugcccgacccaagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccugcagauccccuucgccaugcagauggccuaccgguucaacggcaucggcgugacccagaacgugcuuuacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcucagugcugaacgacauccugagcaggcuggacccacccgaggccgaggugcagaucgaccggcugaucaccggccggcugcagagccugcagaccuacgugacccagcagcugauccgggccgccgagauccgggccagcgccaaccuggcagccauuaagaugagcgagugcgugcugggccagagcaagcggguggacuuuugcggcaagggcuaccaccugaugagcuucccccagagcgcuccccacggcgugguguuccugcacgugaccuacgugcccgcccaggagaagaacuucacaaccgcccccgccaucugccacgacggcaaggcccacuucccccgggagggaguguucgucagcaacggcacccacugguucgugacccagcggaacuucuacgagccccagaucaucaccacccacaacaccuucgugagcggcaacugcgacguggugaucggcaucgugaacaacaccguguacgacccccugcagccugagcucgacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27819 - RNA, 4012 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgugaccagcaaccacaagaacaacaagagcuggauggagagcgaguuccgggucuacagcagcgcuaauaacugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcauugugcgguuccccaacaucaccaaccugugucccuucggcgagguguucaacgccaccaaguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcuccaacguguuccagacccgggccggcugccugaucggcgccgagcacgugaacaacagcuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcagaacguggugaaccagaacgcucaggcccugaacacccuggugaagcagcugagcagcaauuucggcgccaucucaagcgugcugaacgacauccugagccggcuggacccacccgaggccgaggugcagaucgacaggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27820 - RNA, 4018 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcggaccgacagggaccugccccagggauucagcgcccuggagccucugguggaccugcccaucggcaucaacaucacccgguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagacuagcaacuuccgggugcagcccaccgagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggcaagaccggcaagaucgccgacuacaacuacaagcugcccgacgacuucaccggcugcgugaucgccuggaacagcaacaaccuggacagcaaggugggcggcaacuacaaguaccuguaccggcuguuccguaagagcaaccugaagccauucgagcgggauaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggacaucgccgacaccaccgacgcagugcgggacccccagacccuggagauccuggacaucaccccaugcagcuucggcggcgugagcgucaucacacccggcaccaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaucaacuucaccauaagcgugaccaccgagauccugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaggagguguucgcccaagugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggggacaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagccggcuggaucccccagaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27821 - RNA, 4009 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacacaagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcauggccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgcugcccgggaccugaucugcgcccagaaguucaacggccugacugugcugccuccccugcugaccgacgagaugaucgcccaguacaccagcgcccugcuugccggcaccaucaccagcggcuggaccuucggcgcaggcgccgcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcucugggcaagcugcaggacguggugaaccagaacgcccaggcccugaacacccuggugaagcagcugagcagcaacuucggcgccaucagcucagugcugaaugacauccugagcaggcuggacccacccgaggccgaggugcagaucgaccggcugaucaccggccggcugcagagccugcagaccuacgugacccagcagcugauccgggccgccgagauccgggccagcgcaaaccuggccgccaccaagaugagcgagugcgugcugggccagagcaagcggguggacuuuugcggcaagggcuaccaccugaugagcuucccccagagcgcuccccacggcgugguguuccuccacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27822 - RNA, 4009 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacccacccgaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccggaagggaguguucgugagcaacggcaccuacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcuucgugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27823 - RNA, 4003 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguucgacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccuggugguccacaagaacaacaagagcuggauggagagcgaguuccggguguacagcagcgcuaacaauugcaccuucgaguacgugagccagcccuuccugauggaucucgagggcaagcagggcaacuucaagaaccugcgggaguucguguucaagaacaucgacggcuacuucaagaucuacagcaagcacacccccaucaaccuggugcggggccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugccgagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgcagacaccaccgacgccgugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgcugaguacgugaacaacuccuacgagugcgacauccccaucggcgccagcaucugcgccagcuaccagacccagaccaacagcccccggcgggcccggagcguggccagccagagcaucaucgccuacaccaugagcuuaggcgccgagaacagcguggcguacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgcugcccgggaccugaucugcgcccagaaguucaacgggcugaccgugcugcccccucugcugaccgacgagaugaucgcccaguacaccagcgcccugcuugccggcaccaucaccagcggcuggaccuucggcgcaggcgccgcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcucugggcaagcugagggacguggugaaccagaacgcccaggcccugaacacccuggugaagcagcugagcagcaacuucggcgccaucucaagcgugcugaaugacauccugagccggcuggaucccccagaggccgaggugcagaucgaccggcugaucaccggccggcugcagagccugcagaccuacgugacccagcagcugauccgggccgccgagauccgggccagcgcaaaccuggccgccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcuggacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27824 - RNA, 4006 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacacaagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggcgacaucgccgcuagggaccugaucugcgcccagaaguucaacgggcugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugaccuacguccccgcccaggagaagaacuucacaaccgcccccgccauuugccacgacggcaaggcccacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27825 - RNA, 4003 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagaaagcuuaccauguucguguuccuggugcugcugccccuggugagcagccagugcgugaaccugcggacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgugcacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugagggaccugccccagggauucagcgcccuggagccucugguggaccugcccaucggcaucaacaucacccgguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacaccagcaaccagguggccgugcuguaccagggagugaacugcacagaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagaggagcuucaucgaggaccugcuguucaacaaggugacccuggccgacgccggcuucaucaagcaguacggcgacugccugggggauaucgccgcucgggaccugaucugcgcccagaaguucaacggccugacugugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27826 - RNA, 4009 nt, Artificial Sequence
  SARS-CoV-2/Wuhan/WIV05/2019__EPI_ISL_402128 spike protein mRNA gc mod (1-1273)(K986P_V987P)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27827 - RNA, 4009 nt, Artificial Sequence
  SARS-CoV-2/Wuhan/WIV05/2019__EPI_ISL_402128 spike protein mRNA gc mod (1-1273)(K986P_V987P_ D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27828 - RNA, 4009 nt, Artificial Sequence
  SARS-CoV-2/Wuhan/WIV05/2019__EPI_ISL_402128 spike protein mRNA gc mod (1-1273)(K986P_V987P_A222V_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27829 - RNA, 4009 nt, Artificial Sequence
  SARS-CoV-2/Wuhan/WIV05/2019__EPI_ISL_402128 spike protein mRNA gc mod (1-1273)(K986P_V987P_N439K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27830 - RNA, 4009 nt, Artificial Sequence
  SARS-CoV-2/Wuhan/WIV05/2019__EPI_ISL_402128 spike protein mRNA gc mod (1-1273)(K986P_V987P_S477N_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27831 - RNA, 4009 nt, Artificial Sequence
  SARS-CoV-2/Wuhan/WIV05/2019__EPI_ISL_402128 spike protein mRNA gc mod (1-1273)(K986P_V987P_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27832 - RNA, 4003 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27833 - RNA, 4009 nt, Artificial Sequence
  SARS-CoV-2/Wuhan/WIV05/2019__EPI_ISL_402128 spike protein mRNA gc mod (1-1273)(K986P_V987P_Y453F_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27834 - RNA, 4009 nt, Artificial Sequence
  SARS-CoV-2/Wuhan/WIV05/2019__EPI_ISL_402128 spike protein mRNA gc mod (1-1273)(K986P_V987P_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27835 - RNA, 4009 nt, Artificial Sequence
  SARS-CoV-2/Wuhan/WIV05/2019__EPI_ISL_402128 spike protein mRNA gc mod (1-1273)(K986P_V987P_D614G_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27836 - RNA, 4003 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27837 - RNA, 4003 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27838 - RNA, 4000 nt, Artificial Sequence
  SARS-CoV-2/Wuhan/WIV05/2019__EPI_ISL_402128 spike protein mRNA gc mod (1-1273)(K986P_V987P_H69del_V70del_Y144del_N501Y_A570D_D614G_P681 H_T716I_S982A_D1118H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27839 - RNA, 4009 nt, Artificial Sequence
  SARS-CoV-2/Wuhan/WIV05/2019__EPI_ISL_402128 spike protein mRNA gc mod (1-1273)(K986P_V987P_K417N_E484K_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27840 - RNA, 4000 nt, Artificial Sequence
  SARS-CoV-2/Wuhan/WIV05/2019__EPI_ISL_402128 spike protein mRNA gc mod (1-1273)(K986P_V987P_L18F_D80A_D215G_L242del_A243del_L244del_R246 I_K417N_E484K_N501Y_D614G_A701V)
aggagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27841 - RNA, 4009 nt, Artificial Sequence
  SARS-CoV-2/Wuhan/WIV05/2019__EPI_ISL_402128 spike protein mRNA gc mod (1-1273)(K986P_V987P_E484K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27842 - RNA, 4009 nt, Artificial Sequence
  SARS-CoV-2/Wuhan/WIV05/2019__EPI_ISL_402128 spike protein mRNA gc mod (1-1273)(K986P_V987P_L18F_T20N_P26S_D138Y_R190S_K417T_E484K_N501Y _D614G_H655Y_T1027I)
aggagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27843 - RNA, 4009 nt, Artificial Sequence
  SARS-CoV-2/Wuhan/WIV05/2019__EPI_ISL_402128 spike protein mRNA gc mod (1-1273)(K986P_V987P_S13I_W152C_L452R_D614G)
aggagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27844 - RNA, 4000 nt, Artificial Sequence
  SARS-CoV-2/Wuhan/WIV05/2019__EPI_ISL_402128 spike protein mRNA gc mod (1-1273)(K986P_V987P_H69del_V70del_Y144del_E484K_N501Y_A570D_D614 G_P681H_T716I_S982A_D1118H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27845 - RNA, 4000 nt, Artificial Sequence
  SARS-CoV-2/Wuhan/WIV05/2019__EPI_ISL_402128 spike protein mRNA gc mod (1-1273)(K986P_V987P_L18F_D80A_D215G_L242del_A243del_L244del_K417 N_E484K_N501Y_D614G_A701V)
aggagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27846 - RNA, 4000 nt, Artificial Sequence
  SARS-CoV-2/Wuhan/WIV05/2019__EPI_ISL_402128 spike protein mRNA gc mod (1-1273)(K986P_V987P_Q52R_A67V_H69del_V70del_Y144del_E484K_D614G_ Q677H_F888L)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccgcgaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacacacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27847 - RNA, 4000 nt, Artificial Sequence
  SARS-CoV-2/Wuhan/WIV05/2019__EPI_ISL_402128 spike protein mRNA gc mod (1-1273)(K986P_V987P_A67V_H69del_V70del_Y144del_E484K_D614G_Q677H _F888L)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacacacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27848 - RNA, 4009 nt, Artificial Sequence
  SARS-CoV-2/Wuhan/WIV05/2019__EPI_ISL_402128 spike protein mRNA gc mod (1-1273)(K986P_V987P_L18F_T20N_P26S_D138Y_R190S_K417T_E484K_N501Y _D614G_H655Y_T1027I_V1176F)
aggagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27849 - RNA, 4009 nt, Artificial Sequence
  SARS-CoV-2/Wuhan/WIV05/2019__EPI_ISL_402128 spike protein mRNA gc mod (1-1273)(K986P_V987P_E484K_D614G_V1176F)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27850 - RNA, 4009 nt, Artificial Sequence
  SARS-CoV-2/Wuhan/WIV05/2019__EPI_ISL_402128 spike protein mRNA gc mod (1-1273)(K986P_V987P_L452R_D614G_P681R)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27851 - RNA, 4009 nt, Artificial Sequence
  SARS-CoV-2/Wuhan/WIV05/2019__EPI_ISL_402128 spike protein mRNA gc mod (1-1273)(K986P_V987P_E154K_L452R_E484Q_D614G_P681R_Q1071H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggaugaagagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcgugcagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucacgagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27852 - RNA, 4003 nt, Artificial Sequence
  SARS-CoV-2/Wuhan/WIV05/2019__EPI_ISL_402128 spike protein mRNA gc mod (1-1273)(K986P_V987P_T19R_F157del_R158del_L452R_T478K_D614G_P681R _D950N)
aggagaaagcuuaccauguucguguuucuggugcugcugccccugguguccagccagugugugaaccugcgcaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27853 - RNA, 3988 nt, Artificial Sequence
  SARS-CoV-2/Wuhan/WIV05/2019__EPI_ISL_402128 spike protein mRNA gc mod (1-1273)(K986P_V987P_G75V_T76I_R246del_S247del_Y248del_L249del_T2 50del_P251del_G252del_L452Q_F490S_D614G_T859N)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaaugugaucaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccaguaccggcuguuccggaaguccaaucugaagcccuucgagcgggacaucagcaccgaaaucuaucaggccggcagcaccccuugcaacggcguggaaggcuucaacugcuacagcccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugaacgugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27854 - RNA, 4003 nt, Artificial Sequence
  SARS-CoV-2/Wuhan/WIV05/2019__EPI_ISL_402128 spike protein mRNA gc mod (1-1273)(K986P_V987P_H69del_V70del_N439K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27855 - RNA, 4009 nt, Artificial Sequence
  SARS-CoV-2/Wuhan/WIV05/2019__EPI_ISL_402128 spike protein mRNA gc mod (1-1273)(K986P_V987P_L5F_T95I_D253G_E484K_D614G_A701V)
aggagaaagcuuaccauguucguguuuuucgugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27856 - RNA, 4009 nt, Artificial Sequence
  SARS-CoV-2/Wuhan/WIV05/2019__EPI_ISL_402128 spike protein mRNA gc mod (1-1273)(K986P_V987P_L5F_T95I_D253G_S477N_D614G_Q957R)
aggagaaagcuuaccauguucguguuuuucgugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccgcgcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27857 - RNA, 4009 nt, Artificial Sequence
  SARS-CoV-2/Wuhan/WIV05/2019__EPI_ISL_402128 spike protein mRNA gc mod (1-1273)(K986P_V987P_F157L_V367F_Q613H_P681R)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagcugcggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccuuccuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccacgacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27858 - RNA, 4009 nt, Artificial Sequence
  SARS-CoV-2/Wuhan/WIV05/2019__EPI_ISL_402128 spike protein mRNA gc mod (1-1273)(K986P_V987P_S254F_D614G_P681R_G769V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauuucagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagugaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27859 - RNA, 3991 nt, Artificial Sequence
  SARS-CoV-2/Wuhan/WIV05/2019__EPI_ISL_402128 spike protein mRNA gc mod (1-1273)(K986P_V987P_P26S_H69del_V70del_V126A_Y144del_L242del_A24 3del_L244del_H245Y_S477N_E484K_D614G_P681H_T1027I_D1118H)
aggagaaagcuuaccauguucguguuucuggugcugcugccccugguguccagccagugugugaaccugaccaccagaacacagcugccuagcgccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacgccgucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacuguacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27860 - RNA, 4012 nt, Artificial Sequence
  SARS-CoV-2/Wuhan/WIV05/2019__EPI_ISL_402128 spike protein mRNA gc mod (1-1273)(K986P_V987P_T95I_Y144T_Y145S_ins145N_R346K_E484K_N501Y_D 614G_P681H_D950N)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucaccagcaaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccaaguucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27861 - RNA, 4018 nt, Artificial Sequence
  SARS-CoV-2/Wuhan/WIV05/2019__EPI_ISL_402128 spike protein mRNA gc mod (1-1273)(K986P_V987P_ins214TDR_Q414K_N450K_D614G_T716I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggaccgaccgcgaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggaaagacaggcaagaucgccgacuacaacuacaagcugcccgacgacuucaccggcugugugauugccuggaacagcaacaaccuggacuccaaagucggcggcaacuacaaguaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27862 - RNA, 4009 nt, Artificial Sequence
  SARS-CoV-2/Wuhan/WIV05/2019__EPI_ISL_402128 spike protein mRNA gc mod (1-1273)(K986P_V987P_T478K_D614G_P681H_T732A)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccauggccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27863 - RNA, 4009 nt, Artificial Sequence
  SARS-CoV-2/Wuhan/WIV05/2019__EPI_ISL_402128 spike protein mRNA gc mod (1-1273)(K986P_V987P_E484K_N501Y_D614G_P681H_E1092K_H1101Y_V1176F )
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagaaagggcguguucguguccaacggcaccuacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27864 - RNA, 4003 nt, Artificial Sequence
  SARS-CoV-2/Wuhan/WIV05/2019__EPI_ISL_402128 spike protein mRNA gc mod (1-1273)(K986P_V987P_H66D_G142V_Y144del_Y145del_D215G_V483A_D614G _H655Y_G669S_Q949R_N1187D)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguucgacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccuggugguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgccgaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuagcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcgcgacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcuggacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27865 - RNA, 4006 nt, Artificial Sequence
  SARS-CoV-2/Wuhan/WIV05/2019__EPI_ISL_402128 spike protein mRNA gc mod (1-1273)(K986P_V987P_Y144del_L452R_T478K_P681R)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27866 - RNA, 4003 nt, Artificial Sequence
  SARS-CoV-2/Wuhan/WIV05/2019__EPI_ISL_402128 spike protein mRNA gc mod (1-1273)(K986P_V987P_T19R_Y144del_Y145del_L452R_T478K_D614G_P681R )
aggagaaagcuuaccauguucguguuucuggugcugcugccccugguguccagccagugugugaaccugcgcaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaagccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27867 - RNA, 4009 nt, Artificial Sequence
  SARS-CoV-2/Wuhan/WIV05/2019__EPI_ISL_402128 spike protein mRNA gc mod (1-1273)(K986P_V987P)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27868 - RNA, 4009 nt, Artificial Sequence
  SARS-CoV-2/Wuhan/WIV05/2019__EPI_ISL_402128 spike protein mRNA gc mod (1-1273)(K986P_V987P_ D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27869 - RNA, 4009 nt, Artificial Sequence
  SARS-CoV-2/Wuhan/WIV05/2019__EPI_ISL_402128 spike protein mRNA gc mod (1-1273)(K986P_V987P_A222V_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27870 - RNA, 4009 nt, Artificial Sequence
  SARS-CoV-2/Wuhan/WIV05/2019__EPI_ISL_402128 spike protein mRNA gc mod (1-1273)(K986P_V987P_N439K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27871 - RNA, 4009 nt, Artificial Sequence
  SARS-CoV-2/Wuhan/WIV05/2019__EPI_ISL_402128 spike protein mRNA gc mod (1-1273)(K986P_V987P_S477N_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27872 - RNA, 4009 nt, Artificial Sequence
  SARS-CoV-2/Wuhan/WIV05/2019__EPI_ISL_402128 spike protein mRNA gc mod (1-1273)(K986P_V987P_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27873 - RNA, 4003 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27874 - RNA, 4009 nt, Artificial Sequence
  SARS-CoV-2/Wuhan/WIV05/2019__EPI_ISL_402128 spike protein mRNA gc mod (1-1273)(K986P_V987P_Y453F_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27875 - RNA, 4009 nt, Artificial Sequence
  SARS-CoV-2/Wuhan/WIV05/2019__EPI_ISL_402128 spike protein mRNA gc mod (1-1273)(K986P_V987P_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27876 - RNA, 4009 nt, Artificial Sequence
  SARS-CoV-2/Wuhan/WIV05/2019__EPI_ISL_402128 spike protein mRNA gc mod (1-1273)(K986P_V987P_D614G_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27877 - RNA, 4003 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27878 - RNA, 4003 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27879 - RNA, 4000 nt, Artificial Sequence
  SARS-CoV-2/Wuhan/WIV05/2019__EPI_ISL_402128 spike protein mRNA gc mod (1-1273)(K986P_V987P_H69del_V70del_Y144del_N501Y_A570D_D614G_P681 H_T716I_S982A_D1118H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27880 - RNA, 4009 nt, Artificial Sequence
  SARS-CoV-2/Wuhan/WIV05/2019__EPI_ISL_402128 spike protein mRNA gc mod (1-1273)(K986P_V987P_K417N_E484K_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27881 - RNA, 4000 nt, Artificial Sequence
  SARS-CoV-2/Wuhan/WIV05/2019__EPI_ISL_402128 spike protein mRNA gc mod (1-1273)(K986P_V987P_L18F_D80A_D215G_L242del_A243del_L244del_R246 I_K417N_E484K_N501Y_D614G_A701V)
aggagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27882 - RNA, 4009 nt, Artificial Sequence
  SARS-CoV-2/Wuhan/WIV05/2019__EPI_ISL_402128 spike protein mRNA gc mod (1-1273)(K986P_V987P_E484K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27883 - RNA, 4009 nt, Artificial Sequence
  SARS-CoV-2/Wuhan/WIV05/2019__EPI_ISL_402128 spike protein mRNA gc mod (1-1273)(K986P_V987P_L18F_T20N_P26S_D138Y_R190S_K417T_E484K_N501Y _D614G_H655Y_T1027I)
aggagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27884 - RNA, 4009 nt, Artificial Sequence
  SARS-CoV-2/Wuhan/WIV05/2019__EPI_ISL_402128 spike protein mRNA gc mod (1-1273)(K986P_V987P_S13I_W152C_L452R_D614G)
aggagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27885 - RNA, 4000 nt, Artificial Sequence
  SARS-CoV-2/Wuhan/WIV05/2019__EPI_ISL_402128 spike protein mRNA gc mod (1-1273)(K986P_V987P_H69del_V70del_Y144del_E484K_N501Y_A570D_D614 G_P681H_T716I_S982A_D1118H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27886 - RNA, 4000 nt, Artificial Sequence
  SARS-CoV-2/Wuhan/WIV05/2019__EPI_ISL_402128 spike protein mRNA gc mod (1-1273)(K986P_V987P_L18F_D80A_D215G_L242del_A243del_L244del_K417 N_E484K_N501Y_D614G_A701V)
aggagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27887 - RNA, 4000 nt, Artificial Sequence
  SARS-CoV-2/Wuhan/WIV05/2019__EPI_ISL_402128 spike protein mRNA gc mod (1-1273)(K986P_V987P_Q52R_A67V_H69del_V70del_Y144del_E484K_D614G_ Q677H_F888L)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccgcgaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacacacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27888 - RNA, 4000 nt, Artificial Sequence
  SARS-CoV-2/Wuhan/WIV05/2019__EPI_ISL_402128 spike protein mRNA gc mod (1-1273)(K986P_V987P_A67V_H69del_V70del_Y144del_E484K_D614G_Q677H _F888L)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacacacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27889 - RNA, 4009 nt, Artificial Sequence
  SARS-CoV-2/Wuhan/WIV05/2019__EPI_ISL_402128 spike protein mRNA gc mod (1-1273)(K986P_V987P_L18F_T20N_P26S_D138Y_R190S_K417T_E484K_N501Y _D614G_H655Y_T1027I_V1176F)
aggagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27890 - RNA, 4009 nt, Artificial Sequence
  SARS-CoV-2/Wuhan/WIV05/2019__EPI_ISL_402128 spike protein mRNA gc mod (1-1273)(K986P_V987P_E484K_D614G_V1176F)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27891 - RNA, 4009 nt, Artificial Sequence
  SARS-CoV-2/Wuhan/WIV05/2019__EPI_ISL_402128 spike protein mRNA gc mod (1-1273)(K986P_V987P_L452R_D614G_P681R)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27892 - RNA, 4009 nt, Artificial Sequence
  SARS-CoV-2/Wuhan/WIV05/2019__EPI_ISL_402128 spike protein mRNA gc mod (1-1273)(K986P_V987P_E154K_L452R_E484Q_D614G_P681R_Q1071H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggaugaagagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcgugcagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucacgagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27893 - RNA, 4003 nt, Artificial Sequence
  SARS-CoV-2/Wuhan/WIV05/2019__EPI_ISL_402128 spike protein mRNA gc mod (1-1273)(K986P_V987P_T19R_F157del_R158del_L452R_T478K_D614G_P681R _D950N)
aggagaaagcuuaccauguucguguuccuggugcugcugccucugguguccagccagugugugaaccugcgcaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27894 - RNA, 3988 nt, Artificial Sequence
  SARS-CoV-2/Wuhan/WIV05/2019__EPI_ISL_402128 spike protein mRNA gc mod (1-1273)(K986P_V987P_G75V_T76I_R246del_S247del_Y248del_L249del_T2 50del_P251del_G252del_L452Q_F490S_D614G_T859N)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaaugugaucaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccaguaccggcuguuccggaaguccaaucugaagcccuucgagcgggacaucuccaccgagaucuaucaggccggcagcaccccuuguaacggcguggaaggcuucaacugcuacagcccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugaacgugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27895 - RNA, 4003 nt, Artificial Sequence
  SARS-CoV-2/Wuhan/WIV05/2019__EPI_ISL_402128 spike protein mRNA gc mod (1-1273)(K986P_V987P_H69del_V70del_N439K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27896 - RNA, 4009 nt, Artificial Sequence
  SARS-CoV-2/Wuhan/WIV05/2019__EPI_ISL_402128 spike protein mRNA gc mod (1-1273)(K986P_V987P_L5F_T95I_D253G_E484K_D614G_A701V)
aggagaaagcuuaccauguucguguucuucgugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27897 - RNA, 4009 nt, Artificial Sequence
  SARS-CoV-2/Wuhan/WIV05/2019__EPI_ISL_402128 spike protein mRNA gc mod (1-1273)(K986P_V987P_L5F_T95I_D253G_S477N_D614G_Q957R)
aggagaaagcuuaccauguucguguucuucgugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcggcagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccgcgcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27898 - RNA, 4009 nt, Artificial Sequence
  SARS-CoV-2/Wuhan/WIV05/2019__EPI_ISL_402128 spike protein mRNA gc mod (1-1273)(K986P_V987P_F157L_V367F_Q613H_P681R)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgagcugcggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccuuccuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccacgacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27899 - RNA, 4009 nt, Artificial Sequence
  SARS-CoV-2/Wuhan/WIV05/2019__EPI_ISL_402128 spike protein mRNA gc mod (1-1273)(K986P_V987P_S254F_D614G_P681R_G769V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauuucagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagugaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27900 - RNA, 3991 nt, Artificial Sequence
  SARS-CoV-2/Wuhan/WIV05/2019__EPI_ISL_402128 spike protein mRNA gc mod (1-1273)(K986P_V987P_P26S_H69del_V70del_V126A_Y144del_L242del_A24 3del_L244del_H245Y_S477N_E484K_D614G_P681H_T1027I_D1118H)
aggagaaagcuuaccauguucguguuccuggugcugcugccucugguguccagccagugugugaaccugaccaccagaacacagcugccuagcgccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacgccgucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacuguacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27901 - RNA, 4012 nt, Artificial Sequence
  SARS-CoV-2/Wuhan/WIV05/2019__EPI_ISL_402128 spike protein mRNA gc mod (1-1273)(K986P_V987P_T95I_Y144T_Y145S_ins145N_R346K_E484K_N501Y_D 614G_P681H_D950N)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaucgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucaccagcaaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccaaguucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcagaacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27902 - RNA, 4018 nt, Artificial Sequence
  SARS-CoV-2/Wuhan/WIV05/2019__EPI_ISL_402128 spike protein mRNA gc mod (1-1273)(K986P_V987P_ins214TDR_Q414K_N450K_D614G_T716I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggaccgaccgcgaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggaaagacaggcaagaucgccgacuacaacuacaagcugcccgacgacuucaccggcugugugauugccuggaacagcaacaaccuggacuccaaagucggcggcaacuacaaguaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27903 - RNA, 4009 nt, Artificial Sequence
  SARS-CoV-2/Wuhan/WIV05/2019__EPI_ISL_402128 spike protein mRNA gc mod (1-1273)(K986P_V987P_T478K_D614G_P681H_T732A)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccauggccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27904 - RNA, 4009 nt, Artificial Sequence
  SARS-CoV-2/Wuhan/WIV05/2019__EPI_ISL_402128 spike protein mRNA gc mod (1-1273)(K986P_V987P_E484K_N501Y_D614G_P681H_E1092K_H1101Y_V1176F )
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagaaagggcguguucguguccaacggcaccuacugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27905 - RNA, 4003 nt, Artificial Sequence
  SARS-CoV-2/Wuhan/WIV05/2019__EPI_ISL_402128 spike protein mRNA gc mod (1-1273)(K986P_V987P_H66D_G142V_Y144del_Y145del_D215G_V483A_D614G _H655Y_G669S_Q949R_N1187D)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguucgacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccuggugguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgccgaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuagcaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcgcgacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcuggacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27906 - RNA, 4006 nt, Artificial Sequence
  SARS-CoV-2/Wuhan/WIV05/2019__EPI_ISL_402128 spike protein mRNA gc mod (1-1273)(K986P_V987P_Y144del_L452R_T478K_P681R)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27907 - RNA, 4003 nt, Artificial Sequence
  SARS-CoV-2/Wuhan/WIV05/2019__EPI_ISL_402128 spike protein mRNA gc mod (1-1273)(K986P_V987P_T19R_Y144del_Y145del_L452R_T478K_D614G_P681R )
aggagaaagcuuaccauguucguguuccuggugcugcugccucugguguccagccagugugugaaccugcgcaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcguccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaagccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccgccggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27908-28521 - skipped (614 entries)

SEQ ID NO: 28522 - DNA, 140 bp, Artificial Sequence
  HHV5-v1 5'-UTR
ggacagatcgcctggagacgccatccacgctgttttgacctccatagaagacaccgggaccgatccagcctccgcggccgggaacggtgcattggaacgcggattccccgtgccaagagtgactcaccgtccttgacacg

SEQ ID NO: 28523 - RNA, 140 nt, Artificial Sequence
  HHV5-v1 5'-UTR
ggacagaucgccuggagacgccauccacgcuguuuugaccuccauagaagacaccgggaccgauccagccuccgcggccgggaacggugcauuggaacgcggauuccccgugccaagagugacucaccguccuugacacg

SEQ ID NO: 28524 - DNA, 143 bp, Artificial Sequence
  HHV5-v1 5'-UTR
aggagacagatcgcctggagacgccatccacgctgttttgacctccatagaagacaccgggaccgatccagcctccgcggccgggaacggtgcattggaacgcggattccccgtgccaagagtgactcaccgtccttgacacg

SEQ ID NO: 28525 - RNA, 143 nt, Artificial Sequence
  HHV5-v1 5'-UTR
aggagacagaucgccuggagacgccauccacgcuguuuugaccuccauagaagacaccgggaccgauccagccuccgcggccgggaacggugcauuggaacgcggauuccccgugccaagagugacucaccguccuugacacg

SEQ ID NO: 28526 - DNA, 105 bp, Artificial Sequence
  GH1-v1 3'-UTR
cgggtggcatccctgtgacccctccccagtgcctctcctggccctggaagttgccactccagtgcccaccagccttgtcctaataaaattaagttgcatcaagct

SEQ ID NO: 28527 - RNA, 105 nt, Artificial Sequence
  GH1-v1 3'-UTR
cggguggcaucccugugaccccuccccagugccucuccuggcccuggaaguugccacuccagugcccaccagccuuguccuaauaaaauuaaguugcaucaagcu

SEQ ID NO: 28528 - DNA, 198 bp, Artificial Sequence
  PSMB3-v6 3'-UTR
tgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28529 - RNA, 198 nt, Artificial Sequence
  PSMB3-v6 3'-UTR
ugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28530 - DNA, 174 bp, Artificial Sequence
  PSMB3-v7 3'-UTR
tgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28531 - RNA, 174 nt, Artificial Sequence
  PSMB3-v7 3'-UTR
ugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28532 - DNA, 201 bp, Artificial Sequence
  PSMB3-v8 3'-UTR
tgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28533 - RNA, 201 nt, Artificial Sequence
  PSMB3-v8 3'-UTR
ugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28534 - DNA, 177 bp, Artificial Sequence
  PSMB3-v9 3'-UTR
tgatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28535 - RNA, 177 nt, Artificial Sequence
  PSMB3-v9 3'-UTR
ugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28536 - DNA, 204 bp, Artificial Sequence
  PSMB3-v10 3'-UTR
tgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28537 - RNA, 204 nt, Artificial Sequence
  PSMB3-v10 3'-UTR
ugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28538 - DNA, 180 bp, Artificial Sequence
  PSMB3-v11 3'-UTR
tgatgatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28539 - RNA, 180 nt, Artificial Sequence
  PSMB3-v11 3'-UTR
ugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28540 - protein, 1270 aa, Artificial Sequence
  SARS-CoV-2/Wuhan/WIV05/2019__EPI_ISL_402128 spike protein (1-1273)(K986P_V987P_P9L_C136F_Y144del_R190S_D215G_L242del_A243de l_Y449H_E484K_N501Y_D614G_H655Y_N679K_T716I_T859N)
MFVFLVLLLLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFFNDPFLGVYHKNNKSWMESEFRVYSSANNCTFEYVSQPFLMDLEGKQGNFKNLSEFVFKNIDGYFKIYSKHTPINLVRGLPQGFSALEPLVDLPIGINITRFQTLLHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNHNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSPRRARSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLNVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28541 - protein, 1270 aa, Artificial Sequence
  SARS-CoV-2/Wuhan/WIV05/2019__EPI_ISL_402128 spike protein (1-1273)(K986P_V987P_BA.1_v1)
MFVFLVLLPLVSSQCVNLTTRTQLPPAYTNSFTRGVYYPDKVFRSSVLHSTQDLFLPFFSNVTWFHVISGTNGTKRFDNPVLPFNDGVYFASIEKSNIIRGWIFGTTLDSKTQSLLIVNNATNVVIKVCEFQFCNDPFLDHKNNKSWMESEFRVYSSANNCTFEYVSQPFLMDLEGKQGNFKNLREFVFKNIDGYFKIYSKHTPIIVREPEDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNLAPFFTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNKPCNGVAGFNCYFPLRSYSFRPTYGVGHQPYRVVVLSFELLHAPATVCGPKKSTNLVKNKCVNFNFNGLKGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFKGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDIFSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28542 - protein, 1270 aa, Artificial Sequence
  SARS-CoV-2/Wuhan/WIV05/2019__EPI_ISL_402128 spike protein (1-1273)(K986P_V987P_BA.1_v0)
MFVFLVLLPLVSSQCVNLTTRTQLPPAYTNSFTRGVYYPDKVFRSSVLHSTQDLFLPFFSNVTWFHVISGTNGTKRFDNPVLPFNDGVYFASIEKSNIIRGWIFGTTLDSKTQSLLIVNNATNVVIKVCEFQFCNDPFLDHKNNKSWMESEFRVYSSANNCTFEYVSQPFLMDLEGKQGNFKNLREFVFKNIDGYFKIYSKHTPIIVREPEDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNLAPFFTFKCYGVSPTKLNDLCFTNVYADSFVIRGDEVRQIAPGQTGNIADYNYKLPDDFTGCVIAWNSNKLDSKVSGNYNYLYRLFRKSNLKPFERDISTEIYQAGNKPCNGVAGFNCYFPLRSYSFRPTYGVGHQPYRVVVLSFELLHAPATVCGPKKSTNLVKNKCVNFNFNGLKGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFKGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDIFSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28543 - protein, 1273 aa, Artificial Sequence
  SARS-CoV-2/Wuhan/WIV05/2019__EPI_ISL_402128 spike protein (1-1273)(K986P_V987P_B.1.1.529)
MFVFLVLLPLVSSQCVNLTTRTQLPPAYTNSFTRGVYYPDKVFRSSVLHSTQDLFLPFFSNVTWFHVIHVSGTNGTKRFDNPVLPFNDGVYFASIEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNLAPFFTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNKPCNGVAGFNCYFPLRSYSFRPTYGVGHQPYRVVVLSFELLHAPATVCGPKKSTNLVKNKCVNFNFNGLKGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKYFGGFNFSQILPDPSKPSKRSFIEDLLFNKVTLADAGFIKQYGDCLGDIAARDLICAQKFKGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDIFSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28544 - protein, 1270 aa, Artificial Sequence
  SARS-CoV-2/Wuhan/WIV05/2019__EPI_ISL_402128 spike protein (1-1273)(K986P_V987P_BA.2)
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHKNNKSWMESEFRVYSSANNCTFEYVSQPFLMDLEGKQGNFKNLREFVFKNIDGYFKIYSKHTPINLGRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNFAPFFAFKCYGVSPTKLNDLCFTNVYADSFVIRGNEVRQIAPGQTGKIADYNYKLPDDFTGCVIAWNSNNLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28545 - protein, 1266 aa, Artificial Sequence
  SARS-CoV-2/Wuhan/WIV05/2019__EPI_ISL_402128 spike protein (1-1273)(K986P_V987P_G75V_T76I_R246del_S247del_Y248del_L249del_T2 50del_P251del_G252del_D253N_L452Q_F490S_D614G_T859N)
MFVFLVLLPLVSSQCVNLTTRTQLPPAYTNSFTRGVYYPDKVFRSSVLHSTQDLFLPFFSNVTWFHAIHVSGTNVIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHNSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYQYRLFRKSNLKPFERDISTEIYQAGSTPCNGVEGFNCYSPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLNVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28546 - protein, 1273 aa, Artificial Sequence
  SARS-CoV-2/Wuhan/WIV05/2019__EPI_ISL_402128 spike protein (1-1273)(K986P_V987P_T95I_Y144S_Y145N_R346K_E484K_N501Y_D614G_P68 1H_D950N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVSNHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATKFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28547 - protein, 1271 aa, Artificial Sequence
  SARS-CoV-2/Wuhan/WIV05/2019__EPI_ISL_402128 spike protein (1-1273)(K986P_V987P_S12F_H69del_V70del_W152R_R346S_L452R_D614G_Q 677H_A899S)
MFVFLVLLPLVFSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYYHKNNKSRMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATSFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTHTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFSMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28548 - protein, 1273 aa, Artificial Sequence
  SARS-CoV-2/Wuhan/WIV05/2019__EPI_ISL_402128 spike protein (1-1273)(K986P_V987P_I210T_N440K_E484K_D614G_D936N_S939F_T1027I)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPTNLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNKLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQNSLFSTASALGKLQDVVNQNAQALNTLVKQLSSNFGAISSVLNDILSRLDPPEAEVQIDRLITGRLQSLQTYVTQQLIRAAEIRASANLAAIKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28549 - protein, 1273 aa, Artificial Sequence
  SARS-CoV-2/Wuhan/WIV05/2019__EPI_ISL_402128 spike protein (1-1273)(K986P_V987P_W152L_E484K_D614G_G769V)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSLMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTVIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28550 - protein, 1273 aa, Artificial Sequence
  SARS-CoV-2/Wuhan/WIV05/2019__EPI_ISL_402128 spike protein (1-1273)(K986P_V987P_T20I_R357K_D614G)
MFVFLVLLPLVSSQCVNLTIRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKKISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28551 - protein, 1272 aa, Artificial Sequence
  SARS-CoV-2/Wuhan/WIV05/2019__EPI_ISL_402128 spike protein (1-1273)(K986P_V987P_T95I_Y144del_E484K_D614G_P681H_D796H)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKHFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28552 - protein, 1271 aa, Artificial Sequence
  SARS-CoV-2/Wuhan/WIV05/2019__EPI_ISL_402128 spike protein (1-1273)(K986P_V987P_T19R_G142D_E156G_F157del_R158del_L452R_T478K _D614G_P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28553 - protein, 1271 aa, Artificial Sequence
  SARS-CoV-2/Wuhan/WIV05/2019__EPI_ISL_402128 spike protein (1-1273)(K986P_V987P_T19R_T95I_G142D_E156G_F157del_R158del_W258L_ K417N_L452R_T478K_D614G_P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28554 - protein, 1271 aa, Artificial Sequence
  SARS-CoV-2/Wuhan/WIV05/2019__EPI_ISL_402128 spike protein (1-1273)(K986P_V987P_T19R_V70F_G142D_E156G_F157del_R158del_A222V_ K417N_L452R_T478K_D614G_P681R_D950N)
MFVFLVLLPLVSSQCVNLRTRTQLPPAYTNSFTRGVYYPDKVFRSSVLHSTQDLFLPFFSNVTWFHAIHFSGTNGTKRFDNPVLPFNDGVYFASTEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28555 - protein, 1271 aa, Artificial Sequence
  SARS-CoV-2/Wuhan/WIV05/2019__EPI_ISL_402128 spike protein (1-1273)(K986P_V987P_T19R_T95I_G142D_E156G_F157del_R158del_L452R_ T478K_D614G_P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28556 - protein, 1271 aa, Artificial Sequence
  SARS-CoV-2/Wuhan/WIV05/2019__EPI_ISL_402128 spike protein (1-1273)(K986P_V987P_T19R_E156G_F157del_R158del_L452R_T478K_D614G _P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28557 - protein, 1271 aa, Artificial Sequence
  SARS-CoV-2/Wuhan/WIV05/2019__EPI_ISL_402128 spike protein (1-1273)(K986P_V987P_T19R_T95I_G142D_Y145H_E156G_F157del_R158del_ A222V_L452R_T478K_D614G_P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYHHKNNKSWMESGVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28558 - protein, 1273 aa, Artificial Sequence
  SARS-CoV-2/Wuhan/WIV05/2019__EPI_ISL_402128 spike protein (1-1273)(K986P_V987P_T19R_L452R_E484Q_D614G_P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVQGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28559 - protein, 1269 aa, Artificial Sequence
  SARS-CoV-2/Wuhan/WIV05/2019__EPI_ISL_402128 spike protein (1-1273)(K986P_V987P_L452R_D614G_P681R_R682del_R683del_A684del_R6 85del)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28560 - protein, 1269 aa, Artificial Sequence
  SARS-CoV-2/Wuhan/WIV05/2019__EPI_ISL_402128 spike protein (1-1273)(K986P_V987P_E154K_L452R_E484Q_D614G_P681R_R682del_R683de l_A684del_R685del_Q1071H)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMKSEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVQGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAHEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28561 - protein, 1267 aa, Artificial Sequence
  SARS-CoV-2/Wuhan/WIV05/2019__EPI_ISL_402128 spike protein (1-1273)(K986P_V987P_T19R_F157del_R158del_L452R_T478K_D614G_P681R _R682del_R683del_A684del_R685del_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28562 - protein, 1267 aa, Artificial Sequence
  SARS-CoV-2/Wuhan/WIV05/2019__EPI_ISL_402128 spike protein (1-1273)(K986P_V987P_T19R_G142D_E156G_F157del_R158del_L452R_T478K _D614G_P681R_R682del_R683del_A684del_R685del_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28563 - protein, 1267 aa, Artificial Sequence
  SARS-CoV-2/Wuhan/WIV05/2019__EPI_ISL_402128 spike protein (1-1273)(K986P_V987P_T19R_T95I_G142D_E156G_F157del_R158del_W258L_ K417N_L452R_T478K_D614G_P681R_R682del_R683del_A684del_R685del_D95 0N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT
